(12) United States Patent
Lim et al.

(10) Patent No.: US 9,670,281 B2
(45) Date of Patent: Jun. 6, 2017

(54) BINDING-TRIGGERED TRANSCRIPTIONAL SWITCHES AND METHODS OF USE THEREOF

(71) Applicant: The Regents of the University of California, Oakland, CA (US)

(72) Inventors: Wendell A. Lim, San Francisco, CA (US); Leonardo Morsut, San Francisco, CA (US); Kole T. Roybal, San Francisco, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 15/096,971

(22) Filed: Apr. 12, 2016

(65) Prior Publication Data

US 2016/0264665 A1 Sep. 15, 2016

Related U.S. Application Data

(63) Continuation of application No. PCT/US2016/019188, filed on Feb. 23, 2016.

(60) Provisional application No. 62/269,758, filed on Dec. 18, 2015, provisional application No. 62/257,153, filed on Nov. 18, 2015, provisional application No. 62/120,256, filed on Feb. 24, 2015.

(51) Int. Cl.
| | |
|---|---|
| *C12N 5/071* | (2010.01) |
| *C12N 5/16* | (2006.01) |
| *C07K 16/28* | (2006.01) |
| *C07K 14/705* | (2006.01) |
| *C07K 16/30* | (2006.01) |
| *A61K 48/00* | (2006.01) |
| *A61K 35/17* | (2015.01) |

(52) U.S. Cl.
CPC .............. *C07K 16/28* (2013.01); *A61K 48/00* (2013.01); *C07K 14/705* (2013.01); *C07K 16/2803* (2013.01); *C07K 16/30* (2013.01); *A61K 35/17* (2013.01); *C07K 2317/22* (2013.01); *C07K 2317/569* (2013.01); *C07K 2317/622* (2013.01); *C07K 2319/32* (2013.01); *C07K 2319/33* (2013.01); *C07K 2319/60* (2013.01); *C07K 2319/74* (2013.01)

(58) Field of Classification Search
USPC ....................... 435/372.3, 328, 330
See application file for complete search history.

(56) References Cited

U.S. PATENT DOCUMENTS

| | | | |
|---|---|---|---|
| 5,359,046 A | 10/1994 | Capon et al. | |
| 5,712,149 A | 1/1998 | Roberts | |
| 5,830,462 A | 11/1998 | Crabtree et al. | |
| 5,834,266 A | 11/1998 | Crabtree et al. | |
| 5,869,337 A | 2/1999 | Crabtree et al. | |
| 5,871,753 A | 2/1999 | Crabtree et al. | |
| 5,906,936 A | 5/1999 | Eshhar et al. | |
| 5,912,172 A | 6/1999 | Eshhar et al. | |
| 6,133,456 A | 10/2000 | Holt et al. | |
| 6,150,527 A | 11/2000 | Holt et al. | |
| 6,165,787 A | 12/2000 | Crabtree et al. | |
| 6,410,319 B1 | 6/2002 | Raubitschek et al. | |
| 6,649,595 B2 | 11/2003 | Clackson et al. | |
| 7,404,950 B2 | 7/2008 | Spencer et al. | |
| 7,446,179 B2 | 11/2008 | Jensen et al. | |
| 7,446,190 B2 | 11/2008 | Sadelain et al. | |
| 7,741,465 B1 | 6/2010 | Eshhar et al. | |
| 8,106,191 B2 | 1/2012 | Holt et al. | |
| 8,226,943 B2 * | 7/2012 | Gurney ................ | C07K 16/462 424/130.1 |
| 8,399,645 B2 | 3/2013 | Campana et al. | |
| 8,771,671 B2 | 7/2014 | Spencer et al. | |
| 8,911,993 B2 | 12/2014 | June et al. | |
| 8,999,949 B2 | 4/2015 | Spencer et al. | |

(Continued)

FOREIGN PATENT DOCUMENTS

| | | |
|---|---|---|
| WO | WO 2011/119773 A1 | 9/2011 |
| WO | WO 2012/099973 A2 | 7/2012 |

(Continued)

OTHER PUBLICATIONS

Barrett, D.M., Teachey, D.T., and Grupp, S.A. (2014b). Toxicity management for patients receiving novel T-cell engaging therapies. Curr. Opin. Pediatr. 26, 43-49.*
Brentjens CD19-Targeted T Cells Rapidly Induce Molecular Remissions in Adults with Chemotherapy-Refractory Acute Lymphoblastic Leukemia Renier J. cience Translational Medicine Mar. 20, 2013: vol. 5, Issue 177, pp. 1-9.*
Dotti et al (2014). Design and development of therapies using chimeric antigen receptor-expressing T cells. Immunol. Rev. 257, 107-126.*
Abate-Daga CAR models:next-geneartion CAR modifications for enhanced T-cell funcion. Molecular Therapy—Oncolytics (2016) pp. 1-7.*
Barrett et al (2014a). Chimericantigen receptor therapy for cancer. Annu. Rev. Med. 65, 333-347.*
Chillakuri et al., Seminars in Cell & Developmental BiologySeminars in Cell & Developmental Biology 23 (2012) 421-428.*
Daringer et al Modular Extracellular Sensor Architecture for Engineering Mammalian Cell-based Devices ACS Synth. Biol. 2014, 3, 892-902.*

(Continued)

*Primary Examiner* — Maria Leavitt
(74) *Attorney, Agent, or Firm* — Bozicevic Field & Francis, LLP; Paula A. Borden; Otto C. Guedelhoefer

(57) ABSTRACT

The present disclosure provides binding-triggered transcriptional switch polypeptides, nucleic acids comprising nucleotide sequences encoding the binding-triggered transcriptional switch polypeptides, and host cells genetically modified with the nucleic acids. The present disclosure also provides chimeric Notch receptor polypeptides, nucleic acids comprising nucleotide sequences encoding the chimeric Notch receptor polypeptides, and host cells transduced and/or genetically modified with the nucleic acids. The present disclosure provides transgenic organisms comprising a nucleic acid encoding a binding triggered transcriptional switch polypeptide and/or a chimeric Notch receptor polypeptide of the present disclosure. Binding triggered transcriptional switch polypeptides and chimeric Notch receptor polypeptides of the present disclosure are useful in a variety of applications, which are also provided.

24 Claims, 166 Drawing Sheets

(56) References Cited

U.S. PATENT DOCUMENTS

| | | |
|---|---|---|
| 2003/0077249 A1 | 4/2003 | Bebbington et al. |
| 2004/0038886 A1 | 2/2004 | Finney et al. |
| 2004/0058443 A1 | 3/2004 | Artavanis-Tsakonas |
| 2005/0113564 A1 | 5/2005 | Campana et al. |
| 2011/0286980 A1 | 11/2011 | Brenner |
| 2014/0050708 A1 | 2/2014 | Powell et al. |
| 2014/0099309 A1* | 4/2014 | Powell, Jr. ............ A61K 35/17 424/135.1 |
| 2014/0134142 A1 | 5/2014 | Smith et al. |
| 2014/0286987 A1 | 9/2014 | Spencer et al. |
| 2014/0308746 A1 | 10/2014 | Rossi et al. |
| 2015/0164896 A1* | 6/2015 | Lu ........................ A61K 31/517 514/44 R |
| 2015/0190506 A1* | 7/2015 | Cheung .............. C07K 16/2827 424/134.1 |
| 2016/0030694 A1* | 2/2016 | Gingles ................. A61M 16/00 128/200.26 |

FOREIGN PATENT DOCUMENTS

| | | |
|---|---|---|
| WO | WO 2014/039523 A1 | 3/2014 |
| WO | WO 2014/055668 A1 | 4/2014 |
| WO | WO 2015/123527 A1 | 8/2015 |

OTHER PUBLICATIONS

Lecourtois et al Indirect evidence for Delta-dependent intracellular processing of Notch in *Drosophila embryos* Current Biology, vol. 8 No. 13 771-774.*

Morsut et al Engineering Customized Cell Sensing and Response Behaviors Using Synthetic Notch Receptors Cell 164, 780-791, Feb. 11, 2016.*

Porter et al Chimeric Antigen Receptor—Modified T Cells in Chronic Lymphoid Leukemia The new england journal o f medicine 2011;365:725-33.*

Roybal et al Precision Tumor Recognition by T Cells With Combinatorial Antigen-Sensing Circuits Cell 164, 770-779, Feb. 11, 2016.*

Wu et al Remote control of therapeutic T cells through a small moleculegated chimeric receptorScience. Oct. 16, 2015; 350(6258): pp. 1-21.*

Baitsch, et al.; "Extended Co-Expression of Inhibitory Receptors by Human CD8 T-Cells Depending on Differentiation, Antigen-Specificity and Anatomical Localization"; PLoS One; vol. 7, No. 2, 10 pages (Feb. 2012).

Barnea, et al.; "The genetic design of signaling cascades to record receptor activation"; PNAS; vol. 105, No. 1, pp. 64-69 (Jan. 8, 2008).

Fridy, et al.; "A robust pipeline for rapid production of versatile nanobody repertoires"; Nat. Methods; vol. 11, No. 12, pp. 1253-1260 (Dec. 2014).

Gooz; "Adam-17: The Enzyme That Does It All"; Crit. Rev. Biochem. Mol. Biol.; vol. 45, No. 2, pp. 146-169, 146-169 (Apr. 2010).

Gordon, et al.; "Effects of S1 cleavage on the structure, surface export, and signaling activity of human Notch1 and Notch2"; PLoS One; vol. 4, No. 8, 12 pages (Aug. 2009).

Lecourtois, et al.; "Indirect evidence for Delta-dependent intracellular processing of notch in *Drosophila* embryos"; Curr. Biol.; vol. 8, No. 13, pp. 771-774 (Jun. 1998).

Matsuda, et al.; "Synthetic Signal Propagation Through Direct Cell-Cell Interaction"; Sci. Signal; vol. 5, No. 220, 9 pages (Apr. 17, 2012).

Mumm, et al.; "A ligand-induced extracellular cleavage regulates gamma-secretase-like proteolytic activation of Notch1"; Mol. Cell; vol. 5, No. 2, pp. 197-206 (Feb. 2000).

Odorizzi, et al.; "Inhibitory Receptors on Lymphocytes: Insights from Infections"; J. Immunol.; vol. 188, No. 7, pp. 2957-2965 (Apr. 1, 2012).

Sanchez-Irizarry, et al.; "Notch Subunit Heterodimerization and Prevention of Ligand-Independent Proteolytic Activation Depend, Respectively, on a Novel Domain and the LNR Repeats"; Molecular and Cellular Biology; vol. 24, No. 21, 9265-9273 (Nov. 2004).

Struhl, et al.; "Nuclear access and action of notch in vivo"; Cell; vol. 93, No. 4, pp. 649-660 (May 15, 1998).

Supplemental Material for FRIDY, et al.; "A robust pipeline for rapid production of versatile nanobody repertoires"; Nat. Methods; vol. 11, No. 12, pp. 1253-1260 (Dec. 2014).

Vooijs, et al.; "Mapping the consequence of Notch1 proteolysis in vivo with NIP-CRE"; Development; vol. 132, No. 3, pp. 535-544 (Feb. 2007).

Cartellieri, et al.; "Chimeric Antigen Receptor-Engineered T Cells for Immunotherapy of Cancer"; J. Biomed. Biotechnol.; vol. 2010, 13 pages (2010).

Derose, et al.; "Manipulating signaling at will: chemically-inducible dimerization (CID) techniques resolve problems in cell biology"; Pflugers Arch; vol. 465, No. 3, pp. 409-417 (Jan. 9, 2013).

Di Stasi, et al.; "Inducible apoptosis as a safety switch for adoptive cell therapy"; N Engl J Med; vol. 365, No. 18, pp. 1673-1683 (Nov. 3, 2011).

Duttagupta, et al.; "Costimulation Signals for Memory CD8+T Cells During Viral Infections"; Crit. Rev. Immunol.; vol. 29, No. 6, pp. 469-486 (2009).

Fegan, et al.; "Chemically controlled protein assembly: techniques and applications"; Chem Rev; vol. 110, No. 6, pp. 3315-3336 (Jun. 9, 2010).

Gizinski, et al.; "Costimulation and T cells as therapeutic targets"; Best Pract. Res. Clin. Rheumatol.; vol. 24, No. 4, pp. 463-477 (Aug. 2010).

Graef, et al.; "Proximity and orientation underlie signaling by the non-receptor tyrosine kinase ZAP70"; EMBO J; vol. 16, No. 18, pp. 5618-5628 (Sep. 15, 1997).

Isakov; "Immunoreceptor tyrosine-based activation motif (ITAM), a unique module linking antigen and Fc receptors to their signaling cascades"; J. Leukoc . Biol.; vol. 61, No. 1, pp. 6-16 (Jan. 1997).

James, et al.; "Biophysical mechanism of T-cell receptor triggering in a reconstituted system"; Nature; vol. 487, pp. 64-69 (Jul. 5, 2012).

Juillerat, et al.; "Design of chimeric antigen receptors with integrated controllable transient functions"; Scientific Reports; doi: 10.1038/srep18950; 7 pages (Jan. 11, 2016).

Kalos, et al.; "T Cells with Chimeric Antigen Receptors Have Potent Antitumor Effects and Can Establish Memory in Patients with Advanced Leukemia"; Sci Transl Med.; vol. 3, No. 95, 12 pages (Aug. 10, 2011).

Kloss, et al.; "Combinatorial antigen recognition with balanced signaling promotes selective tumor eradication by engineered T cells"; Nat Biotechnol; vol. 31, pp. 71-75 (Dec. 16, 2012).

Kopan, et al.; "The Canonical Notch Signaling Pathway: Unfolding the Activation Mechanism"; Cell; vol. 137, pp. 216-233 (Apr. 17, 2009).

Porter, et al.; "Chimeric antigen receptor-modified T cells in chronic lymphoid leukemia"; Engl J Med; vol. 365, No. 8, pp. 725-733 (Aug. 25, 2011).

Rosenberg; "Raising the bar: the curative potential of human cancer immunotherapy"; Science Translational Medicine; vol. 4, Issue 127, pp. 127ps 8 (Mar. 23, 2012).

Song, et al.; "In vivo persistence, tumor localization and anti-tumor activity of CAR engineered T cells is enhanced by costimulatory signaling through CD137 (4-1BB)"; Cancer Res.; vol. 71, No. 13, pp. 4617-4627 (Jul. 1, 2011).

Tone, et al.; "Cell Fate Conversion by Conditionally Switching the Signal-Transducing Domain of Signalobodies"; Biotechnology and Bioengineering; vol. 110, No. 12, pp. 3219-3226 (Dec. 2013).

Wu, et al.; "Remote control of therapeutic T cells through a small molecule-gated chimeric receptor"; Sciencexpress; sciencemag.org/content/early/recent; doi: 10.1126/science.aab4077; 15 pages (Sep. 24, 2015).

Zhao, et al.; "Multiple injections of electroporated autologous T cells expressing a chimeric antigen receptor mediate regression of human disseminated tumor"; Cancer Res.; vol. 70, No. 22, pp. 9053-9061 (Nov. 15, 2010).

(56) References Cited

OTHER PUBLICATIONS

Kopan, et al.; "The Canonical Notch Signaling Pathway: Unfolding the Activation Mechanism"; Cell; vol. 137, No. 2, pp. 216-233 (Apr. 17, 2009).

Lim; "Designing customized cell signaling circuits"; Nat. Rev. Mol. Cell Biol.; vol. 11, No. 6, pp. 393-403 (Jun. 2010).

Morsut, et al.; Engineering Customized Cell Sensing and Response Behaviors Using Synthetic Notch Receptors; Cell; vol. 164, No. 4, pp. 780-791 (Feb. 11, 2016).

PDB-2004: Structure of LNR-HD (Negative Regulatory Region) from human Notch 2 [online] Apr. 3, 2007 [retrieved May 11, 2016]. Available on the internet: <URL: http://www.rcsb.org/pdb/explore/explore.do?structureId=2004> and <URL: http://www.rcsb.org/pdb/explore/remediatedSequence.do?structureId=2004>.

Roybal, et al.; "Precision Tumor Recognition by T Cells With Combinatorial Antigen-Sensing Circuits"; Cell; vol. 164, No. 4, pp. 770-779 (Feb. 11, 2016).

Chmielewski, et al.; "Antigen-specific T-cell activation independently of the MHC: chimeric antigen receptor-redirected T cells"; Frontiers in Immunology; vol. 4, 7 pages (Nov. 2013).

Gordon, et al.; "Effects of S1 Cleavage on the Structure, Surface Export, and Signaling Activity of Human Notch1 and Notch2"; PloS One; vol. 4, Issue 8, 12 pages (Aug. 2009).

Gordon, et al.; "Mechanical Allostery: Evidence for a Force Requirement in the Proteolytic Activation of Notch"; Developmental Cell; vol. 33, pp. 729-736 (Jun. 22, 2015).

Gordon, et al.; "Structural basis for autoinhibition of Notch"; Nature Structural & Molecular Biology; vol. 14, No. 4, pp. 295-300 and supp. Page (Apr. 2007).

Vardar, et al.; "Nuclear Magnetic Resonance Structure of a Prototype Lin12-Notch Repeat Module from Human Notch1†"; Biochemistry; vol. 42, pp. 7061-7067 (2003).

\* cited by examiner

FIG. 2A

*Homo sapiens* Notch-1
GenBank NP_060087
2555 aa

Grey Background Text – EGF Repeat
Boxed Text – LNR A B and C
Dashed Box Text – S1 cleavage
Dotted Box Text – S2 cleavage
Outlined & Boxed Text – S3 cleavage

```
   1 mppllaplic lallpalaar gprcsqpget clnggkceaa ngteacvcgg afvgprcqdp
  61 npclstpckn agtchvvdrr gvadyacssa lgfsgplclt pldnacltnp crnggtcdll
 121 tlteykcrcp pgwsgksccq adpcasnpca nggclpfea syichppsf hgptcrqdvn
 131 ecgqkpglcr hggtchnevg syrcvcrath tgpnccerpvv pcspspcqng gtcrptgdvt
 241 hecaclpgft gqnceenidd cpgnnckngg acvdgvntyn crcppewtgq yctedvdecq
 301 lmpnacqngg tchnthggyn cvcvngwtge dcseniddca saacfhgatc hdrvasfyce
 361 cphgrtglic hlndacisnp pvngkaictc psgytgpacs qdvdecslga
 421 npccehagkci ntlgsfecqc lggytgprce idvneevsnp cqndatcldq igefqcicmp
 481 gyegvhceevn tdecasspci hngrcldkin efqceeptgf tqhlcqydvd ecastpckng
 541 akcldgpnty tcvctegytg thceevdidec dpdpchygsc kdgvatftcl crpgytghhc
 601 etninecssq pcrhggtcqd rdnaylcfcl kgttgpncei nlddcasspc dsgtcldkid
 661 gyecacepgy tgsmcninid ecagnpchng gtceedingf tcrcpegyhd ptclsevnec
 721 nsnpcvhgac rdslngykcd cdpgwsgtnc dinnnecesn pcvnggtckd mtsgyvctcr
 781 egfsgpncqt ninecasnpc lnqgtciddv agykcncllp ytgatcevvl apcapspcrn
 841 ggecrqsedy esfscvcptg wqggtcevdi necvlspcrh gascqnthgg yrchcqagys
 901 grncetdidd crpnpchngg sctdgintaf cdclpgfrgt fceedineca sdpcrnganc
 961 tdcvdsytct cpagfsgihc ennptpdctes scfnggtcvd ginsftclcp pgftgsycqh
1021 dvneecdsqpc lhggtcqdgc gsyrctcpqg ytgpncqnlv hwcdsspckn ggkcwqthtq
1081 yrccepsgwt glycdvpsvs cevaaqrggv dvarlcqhgg lcvdagnthh crcqagytgs
1141 ycedlvdecs pspcqngatc tdylggysck cvagyhgvnc seeideclsh pcqnggtcld
1201 ipntykcscp rgtggvhcei nvddcnppvd pvsrspkcfn ngtcvdqvgg ysctcppgfv
1261 gercegdvne clsnpcdarg tqncvqrvnd fhccraght grrcesvlng ckgkpckngg
```

FIG. 2A (Continued)

```
1321  tcavasntar gfickcpagf egatcendar tcgslrcing gtcisgprsp tclclgpftg
1381  pecqfpassp ciggngcyng gtceptsesp fyrclcpakf nglichlidy sfgggagrdi
1441  ppplieeace ipecqedagn kvcslqcnnh acgwdggdcs lnfndpwknc tqslqcwkyf
1501  sdghcdsqcn sagclfdgfd cqraeggcnp lydqyckdhf sdghcdggcn saecewdgld
1561  cahvperla agtlvvvlm ppeqlrnssf hflrelsrvi htnvvfkrda hgqqmifpyy
1621  greeelrkhp ikraaegwaa pdallgqvka silpggsegg rrrreldpmd vrgsivylei
1681  dnrqcvqass qcfgsatdva aflgalasig slnipykiea vgsetveppp paqlhfmyva
1741  aaafvliffv qcmlisrkr rrqhgqlwfp egfkvseask kkrrepiged svglkplkna
1801  sdgalmddnq newgdedlet kkfrfeepvv lpdiddgtdh rqwtqqhlda adlrmsamap
1861  tppggevdad cmdvnvrgpd gftpimiasc sgggletgns eeeedapavi sdfiyqgasl
1921  hnqtdrtget alhlaarysr sdaakrilea sadaniqdnm grtplhaavs adaqqvfqil
1981  irnratdlda rmhdgttpli laarlavegm ledlinshad vnavddlqks alhwaaavnn
2041  vdaavvllkn gankdmqnnr eetplfiaar egsyetakvl ldhfanrdit dhmdrlprdi
2101  agermhhdiv rildeynlvr spqihgaplg gtptlsppic spngyigslk pgvggkkvrk
2161  psskglacgs keakdikarr kksgdgkgcl ldssgmlspv dslesphgyl sdvasppllp
2221  spfqgspsvp inhlpgmpdt hlgighlnva akpemaalgg ggrlafetgp prlshlpvas
2281  gtstvlgsss ggalnftvgg stslnggcew lsrlqsgmvp nqynplrgsv apgplstqap
2341  slqhgmvgpl hsslaasals qmmsyqglps trlatqphlv qtqgvqpqnl qmqqqnlqpa
2401  niqqqslqp ppppqphlg vssaasghlg rsflsgepsq advqplgpss lavhtilpqe
2461  spalptslps slvppvtaaq fltppsqhsy sspvdntpsh qlqvpehpfl tpspespdqw
2521  ssssphsnvs dwsegvsspp tsmqsqlari peafk
```

FIG. 2B

Mus musculus Notch-1
GenBank NP_032740
2531 aa

Grey Background Text – EGF Repeat
Boxed Text – LNR A B and C
Dashed Box Text – S1 cleavage
Dotted Box Text – S2 cleavage
Outlined & Boxed Text – S3 cleavage

```
   1 mprlltpllc ltlipalaar glrcsqpsgt clnggrceva ngteacvcsg afvgqrcqds
  61 npclstpckn agtchvvdhg gtvdyacscp lgfsgpiclt pldnaclanp crnggtcdll
 121 tlteykcrcp pgwsgkscqq adpcasnpca nggclpfes syicrcppgf hgptcrqdvn
 181 ecsqnpglcr hggtchneig ecsqnplcr syrcacrath tgphcelpyv pcspspcqng gtcrptgdtt
 241 hecaclpqfa gqnceenvdd cpgnnckngg acvdgvntyn crpppewtgq yctedvdecq
 301 lmpnacqngg tchnthggyn cvcvngwtge dcseniddca saacfggatc hdrvasfyce
 361 cphgrtglic hindacisnp cnegsncdtn pvngkaictc psgytgpacs qdvdecalga
 421 npcehagkcl ntlgsfecqc lqgytgprce idvnecisnp cqndatcldq igefqcicmp
 481 gyegvycein tdecasspcl hnghcmdkin efgcqcpkgf nghlcqydvd ecastpckng
 541 akcldgpnty tcvctegytg thceevdidec dpdpchygsc kdgvatftcl cqpgytghhc
 601 etninechsq pcrhggtcqd rdnsylclcl kgttgpncei niddcasnpc dsgtcldkid
 661 gyecacepgy tgsmcvnid ecagspchng gtcedgiagf tcrcpegyhd ptclsevnec
 721 nsnpcihgac rdgingykcd capgwsgtnc dinnnecesn pcvngtckd mtsgyvctcr
 781 egfsgpncqt ninecasnpc lnggtciddv agykcncpip ytgatceevvi apcatspckn
 841 sgvckesedy esfscvcptg wqgqtcevdi necvksperh gascqptngs yrclcqagyt
 901 grncesdidd crpnpchngg sctdgintaf cdclpgfqga fceedineca snpcqnganc
 961 tdcvdsytct cpvgfngihc enntpdctes scfnggtcvd ginsftclcp pgftgsycqy
1021 dvnecdsrpc lhggtcqdsy gtykctcpqg ytqlncqnlv rwcdsapckn ggrcwqtntq
1081 yhcecrsgwt gvncdvisvs cevaaqkrgi dvtllcqhgg lcvdegdkhy chcqagytgs
1141 ycedevdecs pnpcqngatc tdyiggfsck cvagyhgsnc seeineclsq pcqnggtcid
1201 ltnsykcscp rgtggvhcei nvddchppid pasrspkcfn ngtcvdqygg ytctcppgfv
1261 gercegdvne cisnpcdprg tqnevqrvnd fhcecraght grrceesving crgkpckngg
```

FIG. 2B (Continued)

```
1321  vcavasntar gficrcpagf egatcendar tcqslrclng qtcisgprsp tciclqgsftq
1381  pecqfpassp cvqsncvnq qtcptssnp fvtclcaki nalchily sftggagrdi
1441  pppqieeace lpecqvdagn kvcnlqcnnh acgwdggdcs lnfndpwknc tqsiqcwkyf
1501  sdghcdsqcn sagclfdgfd cqlteggcnp lydqyckdhf sdghcdggcn saecewdqid
1561  cahvperia agtlvlvvli ppdqlrnnsf hflrelshvl htnvvfkrda qggqmifpyy
1621  gheeelrkhp ikrstvgwat sslipgtsgg rqrreldpmd irgsivylei dnrqcvqsss
1681  qcfqsatdva aflgalaslg slnipykiea vksepveppi psqihlmyva aaafvliffv
1741  gdvlisrkr rrqhgqlwfp egfkvseask kkrreplged svgikplkna sdgalmddng
1801  newgdedlet kkfrfeepvv ipdlsdqtdh rqwtqqhlda adirmsamap tppggevdad
1861  cmdvnvrgpd gftplmiasc sgggietgns eeeedapavi sdfiyqgasl hnqtdrtget
1921  aihlaarysr sdaakrilea sadaniqdnm grtplhaavs adaqgvfqil lrnnratdlda
1981  rmhdgttpii laarlavegm ledlinshad vnavddlgks alhwaaavnn vdaavvllkn
2041  gankdmqnnk eetplfiaar egsyetakvl ldhfanrdit dhmdrlprdi aqermhhdiv
2101  rildeynlvr spqlhgtalg gtptisptlc spngylgnik satqgkkark pstkglacgs
2161  keakdikarr kksqdgkgcl ldsssmispv dslesphgyi sdvasppllp spfqqspsmp
2221  lshlpgmpdt higishlnva akpemaalag gsrlafeppp prlshipvas sastvlstng
2281  tgamnftvga paslnggcew iprlqngmvp sqynplrpgv tpgtlistqaa glqhsmmgpl
2341  hssistntls piiygglpnt riatqphlvq tqvqpqnlq iqpqnlqpps qphlsvssaa
2401  nghlgrsfls gepsqadvqp lgpsslpvht llpqesqaip tslpssmvpp mtttqfitpp
2461  sqhsyssspv dntpshqlqv pehpfiltpsp espdqwssss phsnisdwse gisspptmp
2521  sqithipeaf k
```

FIG. 2C

Caenorhabditis elegans Lin-12
GenBank NP_493307.1
1429 aa

Grey Background Text – EGF Repeat
Boxed Text – LNR A B and C
Dashed Box Text – S1 cleavage
Dotted Box Text: - S2 cleavage
Outlined & Boxed Text – S3 cleavage

```
   1 mripticflf llislsksklh igscigliicg rnghchagpv ngtqtsywcr cdegfggeyc
  61 eqgcdvskcg adekcvfdkd yrmetcvckd pdgfkgerce idvneceenk pscpsgyggd dcktqgwcyp
 121 svcmngggci gagnrakcac pdgfkgerce idvneceenk nacgnrstcm ntigtyicvc
 181 pggfippdci kpgntstvef kqpvcfleis adhpdgrsmy cqnggfcdka sskcqcppgy
 241 hgstceilek edscasnpcs hgvcisfsgg fqcicddgys gsycqegkdn cvnnkceags
 301 kcingvnsyf cdcppertgp yceekmdcsai pdicnhgtci dsplsekafe cqcepgyegi
 361 lceqdkneci senmclngt cvnlpgsfrc dcargfggkw cdeplnmcqd fhceendgtcm
 421 htsdhspvcg ckngfigkrc ekecpigfgg vrcdlrleig icsrqggkcf nggkclsgfc
 481 vcppdftgnq cevnrkngks slseniclsd pcmnnatcid vdahigvaci ckqgfeqdic
 541 erhkdlclen pcsnggvchq hresfscdcp pgfvqngceq ekmfxxxxxx ncdadcnyaa
 601 xxxxxxxxxx kinltgftek dslirsvcek rkcserandg ecivdgmdcl pavvrcpvkl
 661 ckfdggdcsg krepfskcry gnmcadffan qvcngacnne ecivdgmdcl efqvtggcsl
 721 rehcasrfan gicdpecntn acgfdggdcd netnatilth iritvqmdpk efqvtggcsl
 781 meissairvt vriqrdeegp lvfqwngese mdrvkmnerq lteghvlsts isrkikrsat
 841 nigvvylev qencdtgkci ykdaqsvvds isarlakkgi dsfgiplsea ivaeprksgn
 901 ntgflswnai lligagcliv mvvimigalp gnrtrkrrmi nasvwmppme neeknrkrhq
 961 sitssqhsll easydgyikr qrnelqhysl ypnpqgygng ndflgdfniht nlqiptepep
1021 espikihtea agsyaitepi tresvniidp rhnrtvlhwi asnssaekse dlivheakec
1081 iaagadvnam dcdentplmi avlarrriv aylmkagadp tiynksersa lhqaaanrdf
1141 gmmvyminst kikgdieeld rngmtalmiv ahnegrdqva sakllvekga kvdydgaark
1201 dsekykgrta lhyaaqvsnm pivkylvgek gsnkdkqded gktpimlaaq egrievvmyl
1261 iqggasveav datdhtarql aqannhhniv difdrcrper eysmdlhigh thqpqpsrkv
1321 trapkkgtsr skkesasnsr dsthltppps dgststpspq hfmnthtthttp tslnylispey
1381 qteagsseaf apqcgafgng emwytrasts ytqmqnepmt rysepahyf
```

FIG. 2D

*Drosophila melanogaster* Notch
GenBank NP_476859.2
2703 aa

Grey Background Text -- EGF Repeat
Boxed Text -- LNR A B and C
Dashed Box Text -- S1 cleavage
Dotted Box Text -- S2 cleavage
Outlined & Boxed Text -- S3 cleavage

```
   1 mqsqrsrrrs rapntwicfw inkmhavasl pasipllllt lafanipntv rgtdtalvaa
  61 sctsvgcqng gtcvtqingk tycacdshyv qdycehrnpc nsmrcqnggt cqvtfrngrp
 121 gisckcplgf deslceiavp nacdhvtcln ggtcqiktle eytcacangy tgercetkni
 181 casspcrnga tctalagsss ftcscppgft gdtcsydiee cqsnpckygg tcvnthgsyq
 241 cmcptgytqk dcdtkykpcs pspcqnggic rsnglsyeck cpkgfegknc eqnyddcigh
 301 lcqnggtcid gisdytcrcp pnfitgrfcqd dvdecaqrdh pvcqngatct nthgsyscic
 361 vngwagidcs nntddckqaa cfygatcidg vgsfycqctk gktglichld dactsnpcha
 421 daicdtspin gsyacscatg ykgvdcsedi decdggspce hngicvntpg syrcncsggf
 481 tgprcetnin eceshpcqne gscldappgtf rcvcmpgftg tqceididec qsnpcindgt
 541 chdkingfkc scalgftgar cqiniddcqs qpcrnrgich dsiagyscec ppqytgtsce
 601 ininddcdsnp chrgkciddv nsfkciccdpg ytgyicqkqi necesnpcqf dghcqdrvgs
 661 yycqcqagts gkncevnvne chsnpcnnga tcidginsyk cqcvpgftgq hceknvdeci
 721 sspcanngvc idqvngykce cprgfydahc lsdvdecasn pcvnegrced qineflchcp
 781 pgytgkrcel cidecssnpc qhggtcydkl nafscqcmpg ytgqkcetni ddcvtnpcgn
 841 ggtcidkvng ykcvckvpft grdceskmdp casnrcknea kctpssnfld fsctckigyt
 901 grycdedide csisspcrng asclnvpgsy rclctkgyeg rdcaintddc asfpcqnggt
 961 cldigdysc lcvdgfdgkh cetdinecls qpcqngatcs qyvnsytctc plgfsgincq
1021 tndedctess cinggscidg ingyncscla gysgancqyk inkcdsnpcl ngatcheqnn
1081 eytchcpsgf tgkqcseyvd wcggspceng atcsqmkhqf sckcssagwtg klcdvqtisc
1141 qdaadrkgls lrqlcnngtc csqgyagsyc qkeidecqsq pcqnggtcrd
```

FIG. 2D (Continued)

```
1201  iigayecqcr qgfgqqncel niddcapnpc qnggtchdrv mnfscscppg tmgiiceink
1261  ddckpgachn ngscidrvgg fecvcqpgfv garcegdine clsnpcsnag tidcvqlvnn
1321  yhcncrpghm grhcehkvdf caqspcqngg ncnirqsghh cicnngfygk ncelsgqaac
1381  snpcxqncy vadcrovqc epntlqeh ceidldecs pnpcaqgaac edlladvecl
1441  cpskwkgkrc diydanypgw nggsgsgndr yaadleqqra mcdkrqctek qgngicdsdq
1501  ntyacnfdgn dcslqinpwa nctanecwnk fkngkcneec nnaachydgh dcerkiksccd
1561  sifdavcqkh ygdqfcdygc nnaecswdgl dcehktqspv laegamsvvm lmnveafrei
1621  qaqfirnmsh mirttvrlkk daighdiiin wkdnvrvpei edtdfarknk lnytqqvhqt
1681  giqiyleidn rkctecftha veaaeflaat aakhqlrndf qihsvrgikn pgdedngepp
1741  anvkyvitgi ilviialaff gmvlstqrkr ahgvtwfpeg frapaavmsr rrrdphgqem
1801  rnlnkqvamq sqgvgqpgah wsddesdmpl pkrqrsdpvs gvglgnnggy asdhtmvsey
1861  eeadqrvwsq ahldvvdvra imtppahqdg gkhdvdargp cgitpimiaa vrggldtge
1921  diennedsta qvisdllagg aelnatmdkt getslhlaar faradaakrl ldagadancq
1981  dntgrtplha avaadamgvf qilirnratn lnarmhdgtt plilaarlai egmvedlita
2041  dadinaadns gktalhwaaa vnnteavnil lmhhanrdaq ddkdetplfl aaregsyeac
2101  kalldnfanr eitdhmdrip rdvaserlhh divrlidehv prspqmlsmt pqamigsppp
2161  gqqpqlitq ptvisagngg nngngnasgk qsnqtakqka akkakiiegs pdngldatgs
2221  irrkasskkt saaskkaanl nginpgqitg gvsgvppgvpp tnsaaqaaaa aaaavaamsh
2281  elegspvgvg mggnlpspyd tssmysnama aplangnpnt gakqppsyed ciknaqsmqs
2341  lqgngldmik ldnyaysngs pfqqelingq glgmngngqr ngvgpgvlpg glcgmgglsg
2401  agngnsheqq lsppysnqsp phsvqsslal sphaylgsps paksrpslpt spthiqamrh
2461  atgqkqfggs nlnsliggan gggvvggggg qqgvggggpq nspvslgiis ptgsdmgiml
2521  appqssknsa imqtispqqq qqqqqqqqqq hqqqqqqqqq qqqqqqqqig giefgsagld
2581  ingfcgspds fhsgqmnpps iqssmsgssp stnmlspssq hngqafyqyl tpssqhsggh
2641  tpqhivqtld syptpspesp ghwsssprs nsdwsegvqs paannlyisg ghqankgsea
2701  iyi
```

FIG. 2E

Bos taurus
Notch receptor
GenBank DAA24217

```
   1 mtpvctptrp gpcahpaipr stphsitdss raepiasflv ispaleirii lavvggdtpl
  61 gdvwaggkas gggdteqpls eqskegeaat gpcapgaewh apristciss tprpeavpps
 121 lpcrspwga cggrrpgpal epahmgsvps qqrpgidrs redngppqpi psphggasla
 181 pappacrgw qppirwpgaa aarvpghirt cspaaicpcc rcliywarfs shcnsrslpg
 241 qdalgpglwv psatqagtrq pvtgstlsgg hatfpriqgm alpepegegp pttsaqgcgp
 301 svraafpgrc qlgavgafhp rgsaagkrea wivpepllgf psssrirgdp gghvpprikk
 361 prqqvakgqp gagvagaepf pvgsagdqaw gwaggkappt pgspatvaar epaqglpdcg
 421 gafaggcqa pnpcisapck nggtchtter egivdyvcgc rigisgpici tprdhaclas
 481 pcingtcdi ititeykclc tpgwsgktcq qadpcasnpc anggqcipfe asyichcppg
 541 fhgptcrqdv necsqspglc hhggtcinev gsyrcvcrpt htgphceipy vpcspspcqn
 601 ggtcrptgdt thecacipgf tgqnceenid dcrpgnsckng gacvdgvnty ncrcppewtg
 661 gyctedvdec qimpnacqng gtchnthggy ncvcvngwtg edcssenidde asascfggat
 721 chdrvaasfyc ecphgrtgil chindacisn pcenegsncdt npvngkaict cpsgytgpac
 781 sqdvdecslg anpcehagkc intlgsfecq ciggytgprc eidvnecvsn pcqndatcld
 841 qigefgcicm pgyegihceev ntdecasspc iqngrcidki nefvceceptg ftghlcqydv
 901 decastpckn gakcidgpnt ytcvctegyt gphcsevdide cdpdpchygs ckdgvatitc
 961 lcqpgytghh cesninechs qpcrhggtcq drdnaylcfc lkgttgpnce iniddcasnp
1021 cdsqtcldki dgyecaceps ytgsmcnini decadspchn ggtcedqing ftcrcpegyh
1081 dptclsevne ossnpcihga crdsingykc dcdpgwsgan cdvnndeces npcingtck
1141 dmtsgyvcac regfsgpncq tninecasnp cinggtcidd vagykcncli pytgatcevv
1201 lapcapgpcr nggecresed yesfscacpa gwggtceid inecvkspcr agascqntng
1261 syrchcqagy tgrncetdid dcrpnpchng gsctdginta fcdclpgfqg afceedinec
1321 asspcrngan ctdcvdsytc tcptgfsgih cenntpdcte sscfnggtcv dginsftclc
1381 ppgftgsycg hdvniecdsrp cihggtchds ygtytctcpg gytginqti vrwcdsspck
1441 ndgrcwqtna lyrcechsgw tglycdvpsv scevaarqgq vnvthicrng gicmnagnth
1501 rchcqagytg syceeqvdec spspcqngat ctdypggysc ecvagyhgvn cseevnecls
1561 qpcrnggtci ditntykcsc prgtqgvhce invddcnppi dpvsrgpkcf nngtcvdqvg
1621 gyscscppgf vgercegdvn eclsnpcdar gtqncvqhvn afhceecragh tgrrcesvin
1681 gckdrpckng gscavasnta rgfickcpag fegatcenda rscgsircin ggtciagprs
1741 ptciclgpft gpeccfpass pcvgqnpcyn ggvcceptaes pfyrcrcpak fngilchild
1801 ysfgggvgid ipppqieetc elpgcreeag nkvcslgcns hacgwdggdc sidfddpwqn
```

FIG. 2E (Continued)

```
1861  ctgslqcwky fsngrcdsqc nsagclfdgf dcqraeggcn plydqyckdh frdghcdqgc
1921  nsaecewdgi dcaehvperi aagtlvlvvl mppeqlrnrs ihflreisrl ihtnvvfkrd
1981  asgqqmifpy ygraplpage rseecrcehh acpagagqge psgplctsrs ivyleidnrq
2041  cvqsssqcfq satdvaafig aiaslgsini pykieavqse tveppppppl hfmyvavvaf
2101  vliffvgcgv lisrkrrrqh gqiwfpegfk vseaskkkrr epigedsvgl kpiknssdga
2161  lmddnqnewg degieakkfr feepvvlpdi ddqtdhrqwt qqhidaadlr vsamaptppq
2221  geadadcmdv nvrgpdgftp lmiascsggg letgnseeee dapavisdfi yqgaslhnqt
2281  drtgetaihi aarysrsdaa krlieasada niqdnmgrtp ihaavsadaq gvfqilirnr
2341  atdidarmhd gttplilaar lavegmledi inshadvnav ddigksaihw aaavnnveaa
2401  vviikngank dmqnnkeetp lfiaaregsy etakvlidhf anrditdhmd riprdiager
2461  mhhdivriid eysivrsppi hgatlggtpt lspplcspng yignlkppmq gkkarkpstk
2521  giacggkepk dikarrkksq dgkgclldsg svmspvdsle sphgylsdva spplipspfq
2581  pspsvplnhi pgmpethigv shisvaakpe mavisggsrl afeagpprls hipvasstst
2641  iigsgsggs gavnftvgga agingqcewi sriqngivpn qvnplrggvt pgtlstqaag
2701  lqhgtvgpih apaisqvmty qaipstrias qphivqpqqn iqmqppsmpp qpnlqphigv
2761  ssaasghigr sfiggelsqa dmqplgpqni aahtvlpqdg qviptsipst iapptmappm
2821  ttaqfltpps qhsyssspvd ntpshqlqvp ehpfltpspe spdqwsssssp hsnisdwseg
2881  isspptsvps qiahvpeafk
```

FIG. 2F

Gallus gallus
Notch receptor
Genbank NP_001025466

```
   1 mgrcsaahpr ggvhcpgica vpdalllfpg vrctqlaesc inggkcetfi ngtevcqcss
  61 ahmgercqlp npcisspckn agtcipllrg stadytcvcr lgftdelclt pldnaclnnp
 121 crnggtcdlv tiseykcrcp pgwsgktccq adpcasnpca nggqvpfea hyicrctagf
 181 hganckqdvn ecnisppvck nggsctnevg tyqcsckpay tqgncehlyv pcnpspcqng
 241 gtcrqtgdtt ydctclpgft gqnceenidd cpqnncrngg tcvdgvntyn cqcppewtgq
 301 yctedvdecq lmpnacqngg tchnnhggyn cvcvngwtge dcseniddca maacfqgatc
 361 hdrvasfyce cphgrtgiic hiddacisnp pvngkaictc psgymgpacn
 421 gqvdecslga npcehagkci ntqgsfqcqc lggysgprce idvneclsnp cqndatcldq
 481 igefqcicmp gyegvycein tdecasspcl hngncldkin efhceeptgf nghlcqfdid
 541 ecastpckng akcvdgpnty scectegfsg vhceididec npdpchygtc kdsiaaftci
 601 cqpgytghrc dinlnecqsq pcrngqtcqd rdnaynclci kgttgpncei nlddcasnpc
 661 dygkcidkin gyectcepgy tgrmcninid ecasnpchng gtckdginqf tclcpegfhd
 721 pkclsevnec nsnpcihgrc hdglngyrcd cdpgwsgtnc dinnecesn pcmnggtckd
 781 mtsgyictcr egfsgpncqt ninecasnpc inggtciddv agytcnclip ytgatcedvi
 841 apcaggpckn ggecresedy krfscscppg wggtceidi necvkspcrn gatcqntngs
 901 yrclcrvgfa grncdtdidd cqpnpchngg scsdgigtff cecla fqrgl kceedineca
 961 snpcknganc tdcvnsytct cpsgfsgihc enntpdctes scfnggtcvd gintftclcp
1021 sgftgsyceh ninecdskpc lnggtcqdsy gtykctcpqg ytglncqnlv rwcdsspckn
1081 ggkcwqtnnl yrceecnsgwt glycdvpsvs cevaakqggi dvahicrnsg lcvdsgnthf
1141 crcqagytgs yceeqvdecs pnpcqngatc tdylgqysce cvagyhgvnc seeineclsh
1201 pcqnggtcid lintykcscp rgtggvhcei nvddcspftd pvtlgpkcfn ngkctdrvgg
1261 yscicppgfv gercegdvne cisnpcdarg tqncvqrvnd ykcecrpgya grrcdtvvdg
1321 ckgkpcrngg tcavasntgr gfickcppgf vgatcendsh tcgtihcing gtcismhkss
1381 kcvcaaaftg pecqypassp cisnpcyngg tcefisdasp vyhcncpanf nglnchildf
1441 dfqggfgqdi ippkieekce iavcasyagn kicdgkcnnh acgwdggdcs lnfndpwknc
1501 sqslgcwkyf ndgkcdsqcn cannmpekla nagclydgfd cckyegqcnp lydyckdhf sdghcdggcn
1561 nfecewdgld cannmpekla dgtlvvvii tpeniknnsf nfirelsrvi htnvvfkkna
1621 kgeymifpyy gneeeikkhy ikrstedwad mssavinkvk ssiysragrr qkreldqmdi
1681 rgsivyleid nrqciqsssq cfqsatdvaa figalasign lnipykieav ksetaeparn
```

FIG. 2F (Continued)

```
1741 sqlypmyvvv aalvilafig vgvlvsrkrr rehgqlwfpe gfkvtesskk krreplgeds
1801 vglkpliknas dgtimddnqn ewgdeetldt kkfrfeeqam lpdtddqtdh rqwtqqhida
1861 adlrissmap tppqgeidad cmdvnvrgpd gftplmiasc sgggletgns eeeddapavi
1921 sdfiyqgasi hnqtdrtget alhlaarysr sdaakrliea sadaniqdnm grtplhaavs
1981 adaggvfqii irnratdlda rmhdgttpli laarlavegm ledlinchad vnavddlgks
2041 alhwaaavnn veaavvllkn gankdmqnnk eetpiflaar egsyetakvl ldhfanrdit
2101 dhmdrlprdi aqermhhdiv rlldeynlvr sppihsgplg aptisppics pssyignikp
2161 avqgkkarkp stkglscngk dskdikarrk ksqdgkgcli dnssvlspvd siesphgyis
2221 dvassplmts pfqqspsmpi nhlpgmpdah msinhlnmag kqemalggsg rmafeavppr
2281 lshipvssps tamsnapmnf svggaaglsg qcdwisrlqs gmvqnqygam rggmqpgthq
2341 qaqniqhgnm sslhnglpst slsqmmsyqa mpstrlasqp hilqnqqmqq mqqpgmqpqp
2401 gmqpqpgmqq pqqpqgqpq pqqhhnpgsn asghmgqnfi gteisqpdnq pvsssamavh
2461 tilpqdsqli ptsipsslaq pmttqfltp psqhsysspi dntpshqiqv pdhpfltpsp
2521 espdqwssss phsnvsdwse gisspptsmq sqmghipeaf k
```

FIG. 2G

Rattus norvegicus Notch receptor
GenBank CAA40667

```
   1 mprliaplic itllpalaar glrcsqpsgt clnggrceeva ngteacvcsg afvggrcqdp
  61 spclstpckn agtcyvvdhg givdyacscp adpcasnpca nggqclpfes syicgcppgf crnggtcdil
 121 titeykcrcp pgwsgkscqq adpcasnpca nggqclpfes syicgcppgf hgptcrqdvn
 181 ecsqnglcr hggtchnelg syrcacrath tgphcelpyv pcspspcqng gtcrptgdtt
 241 hecacipgfa gqnceenvdd cpgnnckngg acvdgvntyn crcppewtgq yctedvdecq
 301 impnacqnag tchnshggyn cvcvngwtge dcsdniddca saacfggatc hdrvasfyce
 361 cphqrtgllc hindacisnp cneqsncdtn pvnqkaictc prgytgpacs qdvdecaiga
 421 npcehagkcl ntlgsfecqc iqgytgprce idvnecisnp cqndatcidg igefqcicmp
 481 gyegvycein tdecaasspcl hngrcvdkin eflcqcpkgf sghlcqydvd ecastpckng
 541 akcldgpnty tcvctegytg thcevdidec dpdpchigic kdgvatftcl cqpgytghhc
 601 etninechsq pcrhggtcqd rdnyylcicl kgttgpncei niddcasnpc dsgtcldkid
 661 gyecacepgy tgsmcvnid ecagspchng gtcedgiagf tcrcpegyhd ptclsevnec
 721 nsnpcihgac rdglngykcd capgwsgtnc dinnnecesn pcvnggtckd mtsgyvctcr
 781 egfsgpncqt ninecasnpc inggtciddv agykcncpip ytgatcevvl apcatspckn
 841 sgvckesedy esfscvcptg wqggtceidi necvkspcrh gasccqntngs yrclcqagyt
 901 grncesdidd crpnpchngg sctdgvnaaf cdclpgfgga fceedineca tnpcqnganc
 961 tdcvdsytct cptgfngihc enntpdctes scfnggtcvd ginsftclcp pgftgsycqy
1021 dvnecdsrpc ihqgtcqdsy gtykctcpag ytglncqnlv rwcdsapckn ggkcwqtntq
1081 yhcecrsgwt gfncdvisvs cevaaqkrgi dvtllcqhgg icvdeedkhy chcqagytgs
1141 ycedevdecs pnpcqngatc tdylggfsck cvagyhgsnc seeinecisq pcqnggtcid
1201 itntykcscp rgtggvhcei nvddchppid pasrspkcfn ngtcvdqvgg yctctcppgfiv
1261 gercegdvne clsnpcdprg tqncvqrvnd fhcecraght grrcesving crgkpcrngg
1321 vcavasntar gficrcparf egatcendar tcgslrclng gtcisgprsp tclclgsftg
1381 pecqfpassp cvgsnpcxng gtceeptsesp fyrclcpakf nglichildy sftgaagrdi
1441 pppqieeace ipecqedagn kvcnlqconh acgwdggdcs lnfndpwknc tqslqcwkyf
1501 sdghcdsqcn sagclfdgfd cqiitegqcnp lydqyckdhf sdghcdggcn saecewdgid
1561 caehvperla agtlvivvil ppdqlrnnsf hflrdvshvl htnvvfkrda qgcmifpyy
1621 greeeirkhp ikrsavgwat tsllpgtngg rqrreidpmd ihgsivyiei dnrgcvgsss
1681 gcfqsatdva aflgalasig sinipykiea vksetveppl psqihlmyva aaaflifffv
1741 gcgvlisrkr rrchgqlwfp egfkvseask kkrrepiged svglkplkna sdgalmddnq
```

FIG. 2G (Continued)

```
1801 newgdediet kkfrfeepvv lpdiddqtdh rqwtqqhida adirvsamap tppqgevdad
1861 cmdvnvrgpd gftplmiasc sgggletgns eeeedapavi sdfiyqgasl hnqtdrtget
1921 aihiaarysr sdaakrliea sadaniqdnm grtplhaavs adaqgvfqil irnratdida
1981 rmhdgttpli laarlavegm ledlinshad vnavddigks aihwaaavnn vdaavviikn
2041 gankdmqnnk eetplflaar egsyetakvi ldhfanirdit dhmdrlprdi aqermhhdiv
2101 rlideynivr spqihgtaig gtptlsptic spngylgnlk satqgkkark pstkglacss
2161 keakdlkarr kksqdgkgci ldsssmlspv dslesphgyl sdvasppilp spfqqspsmp
2221 lshipgmpdt higishlnva akpemaalag gsriafeppp prishlpvas sastvlstng
2281 tgamnftvga pasingqcew lpriqngmvp sqynplrpgv tpgtlstqaa giqhgmmgpi
2341 hssistntis piiyqglpnt riatqphivq tqqvqpqnlq iqpqnlqpps qphlsvssaa
2401 nghigrsfis gepsqadvqp lgpsslpvht ilpqesqalp tsipssmvpp mttqfltpp
2461 sqhsyssspv dntpshqiqv pehpfltpsp espdqwssss rhsnisdwse gisspptsmp
2521 sqithipeaf k
```

FIG. 3

```
mouse 1381  pecqfpassk svgpcyng gvceptaesp fyrcrpakf ngilchildy sftggagrdi
human 1381  pecqfpassp cigpacnnd gtceptsean fyrclchakf ngilchildy sfggagrdi
cow   1752  pecqfpassp cvggnpcynq gvceptaesp fyrcrcpakf ngilchildy sfgggvgidi mouse 1441  pppqieeace ipecqvdagn kvcnlqcnnh acgwdggdcs lnfndpwknc tqslqcwkyf
human 1441  ppplieeace ipecqqedagn kvcslqconh acgwdggdcs lnfndpwknc tqslqcwkyf
cow         pppqieetce ipgcreeagn kvcslqcnsh acgwdggdcs idfddpwqnc tqslqcwkyf mouse 1501  sdghcdsqcn sagclfdgfd cqlteggqcnp lvdqyckdhf sdghcdgqcn saecewdgld
human 1501  sdghcdsqcn sagclfdgfd cqraeggqcnp lvdqyckdhf sdghcdgqcn saecewdgld
cow         sngrcdsqcn sagclfdgfd cqraeggqcnp lvdqyckdhf rdghcdggcn saecewdgld mouse 1561  caehvperla agtlvlvil ppdqlrnnsf hfirelshvi htnvvfkrda qgqqmifpyy
human 1561  caehvperla agtlvlvvvim ppeqlrnssf hfirelsrvi htnvvfkrda hgqqmifpyy
cow         caehvperla agtlvlvlim ppeqlrnrsi hfirelsrli htnvvfkrda sgqqmifpyy mouse 1621  gheeelrkhp ikrstvgwa- -------ts slipgt-sgg rqrre ldpmd irgsivylei
human 1621  greeelrkhp ikraaeqwaa pdallgqvka slippgseegg rrrre ldpmd vrgsivylei
cow         gr-------- ---------- -apl pagerseecr cehhacpaga gggepsgplc tsrsivylei mouse 1681  dnrqcvqsss qcfqsatdva aflgalaslg slnipykiea vksepveppl psqihlmyva
human 1681  dnrqcvqass qcfqsatdva aflgalaslg slnipykiea vqsetveppp paqihfmyva
cow         dnrqcvqsss qcfqsatdva aflgalaslg slnipykiea vqsetveppp pppihfmyva mouse 1741  aaafvllffv gcgvilsrkr
human       aaafvllffv gcgvilsrkr
cow         vvafvllffv gcgvilsrkr
```

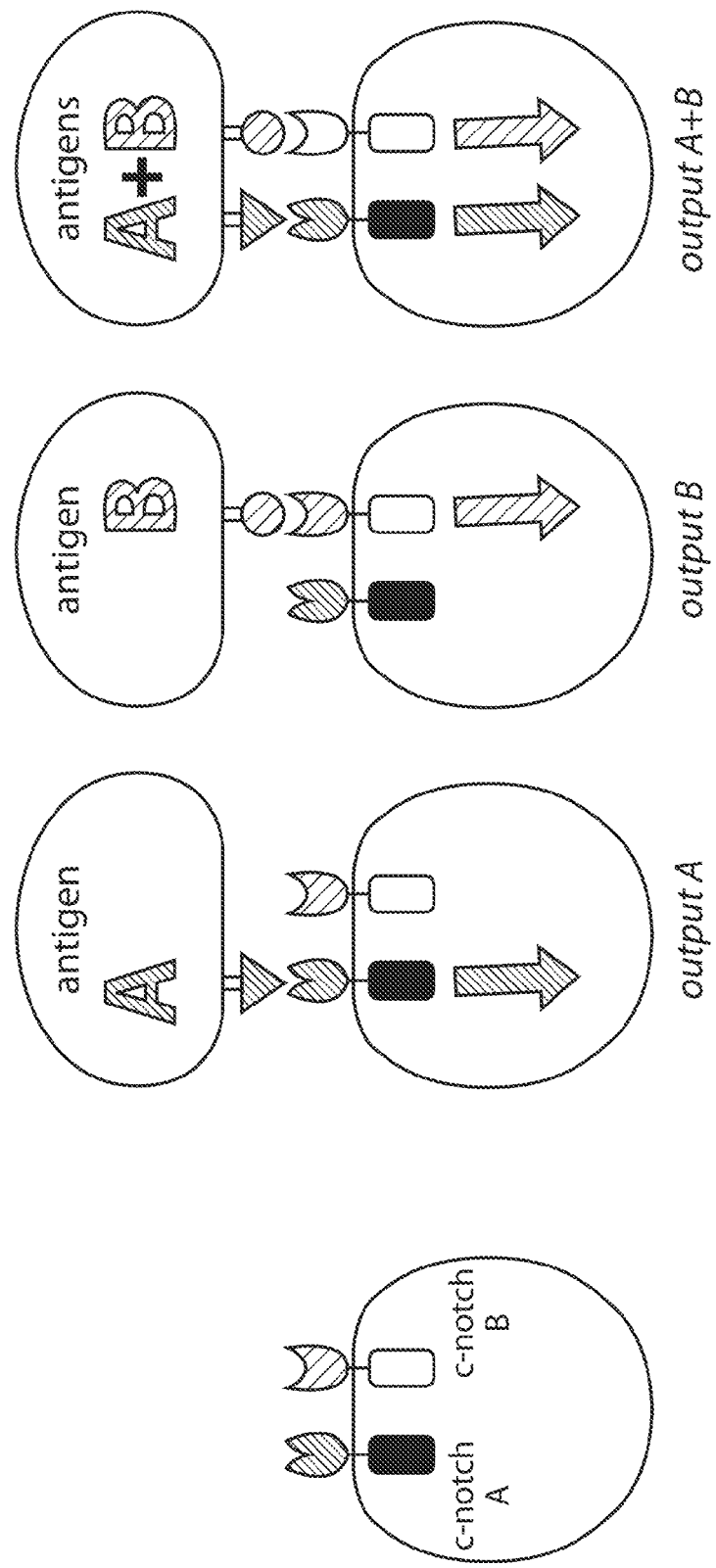

*activation of output requires 2 antigens* split activity (e.g. split txn factor)

FIG. 16A

Notch receptor polypeptide ("Notch regulatory region")

Outlined Text - Lin Notch Repeats (A-C)
Bold Text - Heterodimerization Domains (N and C)
Outlined & Underlined Text - S1 Cleavage
Outlined & Dot Underlined Text - S2 Cleavage
Bold & Underlined Text - S3 Cleavage
Boxed Text - Transmembrane ILDYSFTGGAGRDIPPPQIEEACELPECQVDAGNKVCNLQCNNHACGWDGGDCSLNF
NDPWKNCTQSLQCWKYFSDGHCDSQCNSAGCLFDGFDCQLTEGQCNPLYDQYCKD
HFSDGHCDQGCNSAECEWDGLDCAEHVPERLAAGTLVLVVLLPPDQLRNNSFHFLRE
LSHVLHTNVVFKRDAQGQQMIFPYYGHEEELRKHPIKRSTVGWATSSLLPGTSGGRQR
RELDPMDIRGSIVYLEIDNRQCVQSSSQCFQSATDVAAFLGALASLGSLNIPYKIEAVKS
EPVEPPLPSQLHLMYVAAAAFVLLFFVGCGVLLSRKRRRQLCIQKL

FIG. 16B

Notch receptor polypeptide ("Notch regulatory region") with EGF Repeat

PCVGSNPCYNQGTCEPTSENPFYRCLCPAKFNGLLCHILDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRQLCIQKL

FIG. 16C

CD16A Chimeric Notch iTA

Dashed Box Text – CD16A extracellular domain (AAH36723.1, aa37-242)
Grey Background Text – Notch Regulatory Region
Dotted Box Text – iTA MWQLLLPTALLLLVSAGMRTEDLPKAVVFLEPQWYRVLEKDSVTLKCQGAYSPEDNST
QWFHNESLISSQASSYFIDAATVDDSGEYRCQTNLSTLSDPVQLEVHIGWLLLQAPRW
VFKEEDPIHLRCHSWKNTALHKVTYLQNGKGRKYFHHNSDFYIPKATLKDSGSYFCRG
LFGSKNVSSETVNITITQGLAVSTISSFFPPGILDYSFTGGAGRDIPPPQIEEACELPECQ
VDAGNKVCNLQCNNHACGWDGGDCSLNFNDPWKNCTQSLQCWKYFSDGHCDSQC
NSAGCLFDGFDCQLTEGQCNPLYDQYCKDHFSDGHCDQGCNSAECEWDGLDCAEH
VPERLAAGTLVLVVLLPPDQLRNNSFHFLRELSHVLHTNVVFKRDAQGQQMIFPYYGH
EEELRKHPIKRSTVGWATSSLLPGTSGGRQRRELDPMDIRGSIVYLEIDNRQCVQSSSQ
CFQSATDVAAFLGALASLGSLNIPYKIEAVKSEPVEPPLPSQLHLMYVAAAAFVLLFFVG
CGVLLSRKRRRQLCIQKLMSRLDKSKVINSALELLNEVGIEGLTTRKLAQKLGVEQPTLY
WHVKNKRALLDALAIEMLDRHHTHFCPLEGESWQDFLRNNAKSFRCALLSHRDGAKV
HLGTRPTEKQYETLENQLAFLCQQGFSLENALYALSAVGHFTLGCVLEDQEHQVAKEE
RETPTTDSMPPLLRQAIELFDHQGAEPAFLFGLELIICGLEKQLKCESGGPADALDDFDL
DMLPADALDDFDLDMLPADALDDFDLDMLPG*

FIG. 17A

CD19 Chimeric Notch tTA

Underlined Text – signal sequence
Bold Underlined Text – HA-tag
Dashed Box Text – CD19 extracellular domain (NP_001171569, aa20-91)
Grey Background Text – Notch Regulatory Region
Dotted Box Text – tTA METDTLLLWVLLLWVPGSTGDYPYDVPDYAGAQPARPEEPLVVKVEEGDNAVLQCLK
GTSDGPTQQLTWSRESPLKPFLKLSLGLPGLGIHMRPLAIWLFIFNVSQQMGGFYLCQR
GPPSEKAWQPGWTVNVEGSGELFRWNVSDLGGLGCGLKNRSSEGPSSPSGKLMSP
KLYVWAKDRPEIWEGEPPCLPPRDSLNQSLSQDLTMAPGSTLWLSCGVPPDSVSRGP
LSWTHVHPKGPKSLLSLELKDDRPARDMWVMETGLLLPRATAQDAGKYYCHRGNLTM
SFHLEITARPVLWHWLLRTGGWKLDYSFTGGAGRDIPPPQIEEACELPECQVDAGNKV
CNLQCNNHACGWDGGDCSLNFNDPWKNCTQSLQCWKYFSDGHCDSQCNSAGCLFD
GFDCQLTEGQCNPLYDQYCKDHFSDGHCDQGCNSAECEWDGLDCAEHVPERLAAGT
LVLVVLLPPDQLRNNSFHFLRELSHVLHTNVVFKRDAQGQQMIFPYYGHEEELRKHPIK
RSTVGWATSSLLPGTSGGRQRRELDPMDIRGSIVYLEIDNRQCVQSSSQCFQSATDVA
AFLGALASLGSLNIPYKIEAVKSEPVEPPLPSQLHLMYVAAAAFVLLFFVGCGVLLSRKR
RRQLCIQKLMSRLDKSKVINSALELLNEVGIEGLTTRKLAQKLGVEQPTLYWHVKNKRA
LLDALAIEMLDRHHTHFCPLEGESWQDFLRNNAKSFRCALLSHRDGAKVHLGTRPTEK
QYETLENQLAFLCQQGFSLENALYALSAVGHFTLGCVLEDQEHQVAKEERETPTTDSM
PPLLRQAIELFDHQGAEPAFLFGLELIICGLEKQLKCESGGPADALDDFDLDMLPADALD
DFDLDMLPADALDDFDLDMLPG*

FIG. 17B

Anti-CD19 scFV Chimeric Notch tTA

Underlined Text – signal sequence
Bold Underlined Text – Myc-tag
Dashed Box Text – anti-CD19 scFV
Grey Background Text – Notch Regulatory Region
Dotted Box Text – tTA <u>MALPVTALLLPLALLLHAARP</u>EQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSLDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRQLCIQKLMSRLDKSKVINSALELLNEVGIEGLTTRKLAQKLGVE
QPTLYWHVKNKRALLDALAIEMLDRHHTHFCPLEGESWQDFLRNNAKSFRCALLSHRD
GAKVHLGTRPTEKQYETLENQLAFLCQQGFSLENALYALSAVGHFTLGCVLEDQEHQV
AKEERETPTTDSMPPLLRQAIELFDHQGAEPAFLFGLELIICGLEKQLKCESGGPADALD
DFDLDMLPADALDDFDLDMLPADALDDFDLDMLPG*

FIG. 17C

Anti-CD19 scFv EGF repeat Chimeric Notch tTA

Underlined Text – signal sequence
Bold Underlined Text – Myc-tag
Dashed Box Text – anti-CD19 scFV
Outlined & Underlined Text – EGF Repeat from Notch
Grey Background Text – Notch Regulatory Region
Dotted Box Text – tTA MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQI
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSPCVGSNPCYNQGTCEPTSEN
PFYRCLCPAKFNGLLCHILDYSFTGGAGRDIPPPQIEEACELPECQVDAGNKVCNLQCN
NHACGWDGGDCSLNFNDPWKNCTQSLQCWKYFSDGHCDSQCNSAGCLFDGFDCQL
TEGQCNPLYDQYCKDHFSDGHCDQGCNSAECEWDGLDCAEHVPERLAAGTLVLVVLL
PPDQLRNNSFHFLRELSHVLHTNVVFKRDAQGQQMIFPYYGHEEELRKHPIKRSTVGW
ATSSLLPGTSGGRQRRELDPMDIRGSIVYLEIDNRQCVQSSSQCFQSATDVAAFLGALA
SLGSLNIPYKIEAVKSEPVEPPLPSQLHLMYVAAAAFVLLFFVGCGVLLSRKRRRQLCIQ
KLMSRLDKSKVINSALELLNEVGIEGLTTRKLAQKLGVEQPTLYWHVKNKRALLDALAIE
MLDRHHTHFCPLEGESWQDFLRNNAKSFRCALLSHRDGAKVHLGTRPTEKQYETLEN
QLAFLCQQGFSLENALYALSAVGHFTLGCVLEDQEHQVAKEERETPTTDSMPPLLRQA
ELFDHQGAEPAFLFGLELIICGLEKQLKCESGGPADALDDFDLDMLPADALDDFDLDML
PADALDDFDLDMLPG*

FIG. 18

Anti-Mesothelin scFv EGF repeat Chimeric Notch tTA

Underlined Text – signal sequence
Bold Underlined Text – Flag-tag
Dashed Box Text – anti-mesothelin scFv
Outlined & Underlined Text – EGF Repeat from Notch
Grey Background Text – Notch Regulatory Region
Dotted Box Text – tTA <u>MALPVTALLLPLALLLHAARP</u>DYKDDDDKGSQVQLQQSGPELEKPGASVKISCKASGY
SFTGYTMNWVKQSHGKSLEWIGLITPYNGASSYNQKFRGKATLTVDKSSSTAYMDLLS
LTSEDSAVYFCARGGYDGRGFDYWGQGTTVTVSSGGGGSGGGGSSGGGSDIELTQS
PAIMSASPGEKVTMTCSASSSVSYMHWYQQKSGTSPKRWIYDTSKLASGVPGRFSGS
GSGNSYSLTISSVEAEDDATYYCQQWSKHPLTYGAGTKLEIKASPCVGSNPCYNQGTC
EPTSENPFYRCLCPAKFNGLLCHILDYSFTGGAGRDIPPPQIEEACELPECQVDAGNKV
CNLQCNNHACGWDGGDCSLNFNDPWKNCTQSLQCWKYFSDGHCDSQCNSAGCLFD
GFDCQLTEGQCNPLYDQYCKDHFSDGHCDQGCNSAECEWDGLDCAEHVPERLAAGT
LVLVVLLPPDQLRNNSFHFLRELSHVLHTNVVFKRDAQGQQMIFPYYGHEEELRKHPIK
RSTVGWATSSLLPGTSGGRQRRELDPMDIRGSIVYLEIDNRQCVQSSSQCFQSATDVA
AFLGALASLGSLNIPYKIEAVKSEPVEPPLPSQLHLMYVAAAAFVLLFFVGCGVLLSRKR
RRQLCIQKLMSRLDKSKVINSALELLNEVGIEGLTTRKLAQKLGVEQPTLYWHVKNKRA
LLDALAIEMLDRHHTHFCPLEGESWQDFLRNNAKSFRCALLSHRDGAKVHLGTRPTEK
QYETLENQLAFLCQQGFSLENALYALSAVGHFTLGCVLEDQEHQVAKEERETPTTDSM
PPLLRQAIELFDHQGAEPAFLFGLELIICGLEKQLKCESGGPADALDDFDLDMLPADALD
DFDLDMLPADALDDFDLDMLPG*

FIG. 19A

Anti-myc scFv Chimeric Notch tTA

Underlined Text – signal sequence
Bold Underlined Text – Flag-tag
Dashed Box Text – anti-Myc scFv
Grey Background Text – Notch Regulatory Region
Dotted Box Text – tTA MALPVTALLLPLALLLHAARPDYKDDDDKGSQVQLQQQVQLQESGGDLVKPGGSLKLS
CAASGFTFSHYGMSWVRQTPDKRLEWVATIGSRGTYTHYPDSVKGRFTISRDNDKNA
LYLQMNSLKSEDTAMYYCARRSEFYYYGNTYYYSAMDYWGQGASVTVSSGGGGSGG
GGSGGGGSDIVLTQSPAFLAVSLGQRATISCRASESVDNYGFSFMNWFQQKPGQPPK
LLIYAISNRGSGVPARFSGSGSGTDFSLNIHPVEEDDPAMYFCQQTKEVPWTFGGGTK
LEIKLDYSFTGGAGRDIPPPQIEEACELPECQVDAGNKVCNLQCNNHACGWDGGDCS
LNFNDPWKNCTQSLQCWKYFSDGHCDSQCNSAGCLFDGFDCQLTEGQCNPLYDQYC
KDHFSDGHCDQGCNSAECEWDGLDCAEHVPERLAAGTLVLVVLLPPDQLRNNSFHFL
RELSHVLHTNVVFKRDAQGQQMIFPYYGHEEELRKHPIKRSTVGWATSSLLPGTSGGR
QRRELDPMDIRGSIVYLEIDNRQCVQSSSQCFQSATDVAAFLGALASLGSLNIPYKIEAV
KSEPVEPPLPSQLHLMYVAAAAFVLLFFVGCGVLLSRKRRRQLCIQKLMSRLDKSKVIN
SALELLNEVGIEGLTTRKLAQKLGVEQPTLYWHVKNKRALLDALAIEMLDRHHTHFCPL
EGESWQDFLRNNAKSFRCALLSHRDGAKVHLGTRPTEKQYETLENQLAFLCQQGFSL
ENALYALSAVGHFTLGCVLEDQEHQVAKEERETPTTDSMPPLLRQAIELFDHQGAEPA
FLFGLELIICGLEKQLKCESGGPADALDDFDLDMLPADALDDFDLDMLPADALDDFDLD
MLPG*

FIG. 19B

Myc-tag Chimeric Notch tTA

Underlined Text – signal sequence
Bold Underlined Text – Myc-tag
Dashed Box Text – anti-Myc scFv
Grey Background Text – Notch Regulatory Region
Dotted Box Text – tTA MALPVTALLLPLALLLHAARPEQKLISEEDLGSQVQLQQQVQLQESGGDLVKPGGSLKL
SCAASGFTFSHYGMSWVRQTPDKRLEWVATIGSRGTYTHYPDSVKGRFTISRDNDKN
ALYLQMNSLKSEDTAMYYCARRSEFYYYGNTYYYSAMDYWGQGASVTVSSGGGGSG
GGGSGGGGSDIVLTQSPAFLAVSLGQRATISCRASESVDNYGFSFMNWFQQKPGQPP
KLLIYAISNRGSGVPARFSGSGSGTDFSLNIHPVEEDDPAMYFCQQTKEVPWTFGGGT
KLEIKLDYSFTGGAGRDIPPPQIEEACELPECQVDAGNKVCNLQCNNHACGWDGGDC
SLNFNDPWKNCTQSLQCWKYFSDGHCDSQCNSAGCLFDGFDCQLTEGQCNPLYDQY
CKDHFSDGHCDQGCNSAECEWDGLDCAEHVPERLAAGTLVLVVLLPPDQLRNNSFHF
LRELSHVLHTNVVFKRDAQGQQMIFPYYGHEEELRKHPIKRSTVGWATSSLLPGTSGG
RQRRELDPMDIRGSIVYLEIDNRQCVQSSSQCFQSATDVAAFLGALASLGSLNIPYKIEA
VKSEPVEPPLPSQLHLMYVAAAAFVLLFFVGCGVLLSRKRRRQLCIQKLMSRLDKSKVI
NSALELLNEVGIEGLTTRKLAQKLGVEQPTLYWHVKNKRALLDALAIEMLDRHHTHFCP
LEGESWQDFLRNNAKSFRCALLSHRDGAKVHLGTRPTEKQYETLENQLAFLCQQGFS
LENALYALSAVGHFTLGCVLEDQEHQVAKEERETPTTDSMPPLLRQAIELFDHQGAEPA
FLFGLELIICGLEKQLKCESGGPADALDDFDLDMLPADALDDFDLDMLPADALDDFDLD
MLPG*

FIG. 20A

Anti-GFP Nanobody (LaG 9) Chimeric Notch tTA

*nanobody peptide sequence derived from: Nature Methods 11,1253–1260 (2014) supplementary information Underlined Text – signal sequence
Bold Underlined Text – Myc-tag
Dashed Box Text – LaG 9 nanobody
Grey Background Text – Notch Regulatory Region
Dotted Box Text – tTA MALPVTALLLPLALLLHAARPEQKLISEEDLMADVQLVESGGGLVQAGGSLRLSCAASG
RTFSTSAMGWFRQAPGKEREFVARITWSAGYTAYSDSVKGRFTISRDKAKNTVYLQM
NSLKPEDTAVYYCASRSAGYSSSLTRREDYAYWGQGTQVTVSLDYSFTGGAGRDIPP
PQIEEACELPECQVDAGNKVCNLQCNNHACGWDGGDCSLNFNDPWKNCTQSLQCW
KYFSDGHCDSQCNSAGCLFDGFDCQLTEGQCNPLYDQYCKDHFSDGHCDQGCNSAE
CEWDGLDCAEHVPERLAAGTLVLVVLLPPDQLRNNSFHFLRELSHVLHTNVVFKRDAQ
GQQMIFPYYGHEEELRKHPIKRSTVGWATSSLLPGTSGGRQRRELDPMDIRGSIVYLEI
DNRQCVQSSSQCFQSATDVAAFLGALASLGSLNIPYKIEAVKSEPVEPPLPSQLHLMYV
AAAAFVLLFFVGCGVLLSRKRRRQLCIQKLMSRLDKSKVINSALELLNEVGIEGLTTRKL
AQKLGVEQPTLYWHVKNKRALLDALAIEMLDRHHTHFCPLEGESWQDFLRNNAKSFR
CALLSHRDGAKVHLGTRPTEKQYETLENQLAFLCQQGFSLENALYALSAVGHFTLGCV
LEDQEHQVAKEERETPTTDSMPPLLRQAIELFDHQGAEPAFLFGLELIICGLEKQLKCES
GGPADALDDFDLDMLPADALDDFDLDMLPADALDDFDLDMLPG*

FIG. 20B

Anti-GFP Nanobody (LaG 50) Chimeric Notch tTA

*nanobody peptide sequence derived from: Nature Methods 11,1253–1260 (2014) supplementary information Underlined Text – signal sequence
Bold Underlined Text – Myc-tag
Dashed Box Text – LaG 50 nanobody
Grey Background Text – Notch Regulatory Region
Dotted Box Text – tTA MALPVTALLLPLALLLHAARPEQKLISEEDLMADVQLVESGGGLVQAGGSLRLSCAASG
RTISMAAMSWFRQAPGKEREFVAGISRSAGSAVHADSVKGRFTISRDNTKNTLYLQMN
SLKAEDTAVYYCAVRTSGFFGSIPRTGTAFDYWGQGTQVTVSLDYSFTGGAGRDIPPP
QIEEACELPECQVDAGNKVCNLQCNNHACGWDGGDCSLNFNDPWKNCTQSLQCWK
YFSDGHCDSQCNSAGCLFDGFDCQLTEGQCNPLYDQYCKDHFSDGHCDQGCNSAEC
EWDGLDCAEHVPERLAAGTLVLVVLLPPDQLRNNSFHFLRELSHVLHTNVVFKRDAQG
QQMIFPYYGHEEELRKHPIKRSTVGWATSSLLPGTSGGRQRRELDPMDIRGSIVYLEID
NRQCVQSSSQCFQSATDVAAFLGALASLGSLNIPYKIEAVKSEPVEPPLPSQLHLMYVA
AAAFVLLFFVGCGVLLSRKRRRQLCIQKLMSRLDKSKVINSALELLNEVGIEGLTTRKLA
QKLGVEQPTLYWHVKNKRALLDALAIEMLDRHHTHFCPLEGESWQDFLRNNAKSFRC
ALLSHRDGAKVHLGTRPTEKQYETLENQLAFLCQQGFSLENALYALSAVGHFTLGCVL
EDQEHQVAKEERETPTTDSMPPLLRQAIELFDHQGAEPAFLFGLELIICGLEKQLKCES
GGPADALDDFDLDMLPADALDDFDLDMLPADALDDFDLDMLPG*

FIG. 20C

Anti-GFP Nanobody (LaG 18) Chimeric Notch tTA

*nanobody peptide sequence derived from: Nature Methods 11,1253–1260 (2014) supplementary information Underlined Text – signal sequence
Bold Underlined Text – Myc-tag
Dashed Box Text – LaG 18 nanobody
Grey Background Text – Notch Regulatory Region
Dotted Box Text – tTA MALPVTALLLPLALLLHAARPEQKLISEEDLMAQVQLVESGGGLVQTGGSLKLSCTASV
RTLSYYHVGWFRQAPGKEREFVAGIHRSGESTFYADSVKGRFTISRDNAKNTVHLQMN
SLKPEDTAVYYCAQRVRGFFGPLRSTPSWYDYWGQGTQVTVSLDYSFTGGAGRDIP
PPQIEEACELPECQVDAGNKVCNLQCNNHACGWDGGDCSLNFNDPWKNCTQSLQC
WKYFSDGHCDSQCNSAGCLFDGFDCQLTEGQCNPLYDQYCKDHFSDGHCDQGCNS
AECEWDGLDCAEHVPERLAAGTLVLVVLLPPDQLRNNSFHFLRELSHVLHTNVVFKRD
AQGQQMIFPYYGHEEELRKHPIKRSTVGWATSSLLPGTSGGRQRRELDPMDIRGSIVY
LEIDNRQCVQSSSQCFQSATDVAAFLGALASLGSLNIPYKIEAVKSEPVEPPLPSQLHLM
YVAAAAFVLLFFVGCGVLLSRKRRRQLCIQKLMSRLDKSKVINSALELLNEVGIEGLTTR
KLAQKLGVEQPTLYWHVKNKRALLDALAIEMLDRHHTHFCPLEGESWQDFLRNNAKSF
RCALLSHRDGAKVHLGTRPTEKQYETLENQLAFLCQQGFSLENALYALSAVGHFTLGC
VLEDQEHQVAKEERETPTTDSMPPLLRQAIELFDHQGAEPAFLFGLELIICGLEKQLKCE
SGGPADALDDFDLDMLPADALDDFDLDMLPADALDDFDLDMLPG*

FIG. 20D

Anti-GFP Nanobody (LaG 16/LaG 2) Chimeric Notch tTA

*nanobody peptide sequence derived from: Nature Methods 11,1253–1260 (2014) supplementary information Underlined Text – signal sequence
Bold Underlined Text – Myc-tag
Dashed Box Text – LaG 16 3xG4S LaG2 nanobody
Grey Background Text – Notch Regulatory Region
Dotted Box Text – tTA MALPVTALLLPLALLLHAARPEQKLISEEDLMAQVQLVESGGRLVQAGDSLRLSCAASG
RTFSTSAMAWFRQAPGREREFVAAITWTVGNTILGDSVKGRFTISRDRAKNTVDLQMD
NLEPEDTAVYYCSARSRGYVLSVLRSVDSYDYWGQGTQVTVSGGGGSGGGGSGGG
GSMAQVQLVESGGGLVQAGGSLRLSCAASGRTFSNYAMGWFRQAPGKEREFVAAIS
WTGVSTYYADSVKGRFTISRDNDKNTVYVQMNSLIPEDTAIYYCAAVRARSFSDTYSRV
NEYDYWGQGTQVTVLDYSFTGGAGRDIPPPQIEEACELPECQVDAGNKVCNLQCNN
HACGWDGGDCSLNFNDPWKNCTQSLQCWKYFSDGHCDSQCNSAGCLFDGFDCQLT
EGQCNPLYDQYCKDHFSDGHCDQGCNSAECEWDGLDCAEHVPERLAAGTLVLVVLL
PPDQLRNNSFHFLRELSHVLHTNVVFKRDAQGQQMIFPYYGHEEELRKHPIKRSTVGW
ATSSLLPGTSGGRQRRELDPMDIRGSIVYLEIDNRQCVQSSSQCFQSATDVAAFLGALA
SLGSLNIPYKIEAVKSEPVEPPLPSQLHLMYVAAAAFVLLFFVGCGVLLSRKRRRQLCIQ
KLMSRLDKSKVINSALELLNEVGIEGLTTRKLAQKLGVEQPTLYWHVKNKRALLDALAIE
MLDRHHTHFCPLEGESWQDFLRNNAKSFRCALLSHRDGAKVHLGTRPTEKQYETLEN
QLAFLCQQGFSLENALYALSAVGHFTLGCVLEDQEHQVAKEERETPTTDSMPPLLRQAI
ELFDHQGAEPAFLFGLELIICGLEKQLKCESGGPADALDDFDLDMLPADALDDFDLDML
PADALDDFDLDMLPG*

FIG. 21

PD-1 extracellular domain EGF Repeat Chimeric Notch

Underlined Text – signal sequence
Bold Underlined Text – Myc-tag
Dashed Box Text – PD-1 extracellular domain (NP_005009.2)
Outlined & Underlined Text – EGF Repeat from Notch
Grey Background Text – Notch Regulatory Region
Dotted Box Text – tTA MALPVTALLLPLALLLHAARP**MQIPQAPWPVVWAVLQLGWRPGWFLDSPDRPWNPPT
FSPALLVVTEGDATFTCSFSNTSESFVLNWYRMSPSNQTDKLAAFPEDRSQPGQDCR
FRVTQLPNGRDFHMSVVRARRNDSGTYLCGAISLAPKAQIKESLRAELRVTERRAEVPT**
AHPSPSPRPAGQFQEQKLISEEDLPCVGSNPCYNQGTCEPTSENPFYRCLCPAKFNGL
LCHILDYSFTGGAGRDIPPPQIEEACELPECQVDAGNKVCNLQCNNHACGWDGGDCS
LNFNDPWKNCTQSLQCWKYFSDGHCDSQCNSAGCLFDGFDCQLTEGQCNPLYDQYC
KDHFSDGHCDQGCNSAECEWDGLDCAEHVPERLAAGTLVLVVLLPPDQLRNNSFHFL
RELSHVLHTNVVFKRDAQGQQMIFPYYGHEEELRKHPIKRSTVGWATSSLLPGTSGGR
QRRELDPMDIRGSIVYLEIDNRQCVQSSSQCFQSATDVAAFLGALASLGSLNIPYKIEAV
KSEPVEPPLPSQLHLMYVAAAAFVLLFFVGCGVLLSRKRRRQLCIQKLMSRLDKSKVIN
SALELLNEVGIEGLTTRKLAQKLGVEQPTLYWHVKNKRALLDALAIEMLDRHHTHFCPL
EGESWQDFLRNNAKSFRCALLSHRDGAKVHLGTRPTEKQYETLENQLAFLCQQGFSL
ENALYALSAVGHFTLGCVLEDQEHQVAKEERETPTTDSMPPLLRQAIELFDHQGAEPA
FLFGLELIICGLEKQLKCESGGPADALDDFDLDMLPADALDDFDLDMLPADALDDFDLD
MLPG*

FIG. 22

Anti-CD19 scFV Chimeric Notch Gal4VP64

Underlined Text – signal sequence
Bold Underlined Text – Myc-tag
Dashed Box Text – anti-CD19 scFV
Grey Background Text – Notch Regulatory Region
Dotted Box Text – Gal4 VP64

MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSILDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRQLCIQKLMKLLSSIEQACDICRLKKLKCSKEKPKCAKCLKNNW
ECRYSPKTKRSPLTRAHLTEVESRLERLEQLFLLIFPREDLDMILKMDSLQDIKALLTGLF
VQDNVNKDAVTDRLASVETDMPLTLRQHRISATSSSEESSNKGQRQLTVSAAAGGSG
GSGGSDALDDFDLDMLGSDALDDFDLDMLGSDALDDFDLDMLGSDALDDFDLDMLGS
*

FIG. 23

Anti-CD19 scFV Chimeric Notch Zip(-) Gal4 DNA Binding Domain

Underlined Text – signal sequence
Bold Underlined Text – Myc-tag
Dashed Box Text – anti-CD19 scFV
Grey Background Text – Notch Regulatory Region
Dotted Box Text – zip(-) Gal4 DNA Binding Domain MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSILDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRQLCILLEIRAAFLRQRNTALRTEVAELEQEVQRLENEVSQYET
RYGPLGGGKGGSGGGSGGSMKLLSSIEQACDICRLKKLKCSKEKPKCAKCLKNNWECR
YSPKTKRSPLTRAHLTEVESRLERLEQLFLLIFPREDLDMILKMDSLQDIKALLTGLFVQD
NVNKDAVTDRLASVETDMPLTLRQHRISATSSSEESSNKGQRQLTVSAA*

FIG. 24

Anti-Meothelin scFv Chimeric Notch NLS VP64 Zip(+)

Underlined Text – signal sequence
Bold Underlined Text – Flag-tag
Dashed Box Text – anti-Mesothelin scFv
Outlined & Underlined Text – EGF Repeat
Grey Background Text – Notch Regulatory Region
Dotted Box Text – NLS VP64 zip(+)

<u>MALPVTALLLPLALLLHAARP</u>DYKDDDDKGSQVQLQQSGPELEKPGASVKISCKASGY
SFTGYTMNWVKQSHGKSLEWIGLITPYNGASSYNQKFRGKATLTVDKSSSTAYMDLLS
LTSEDSAVYFCARGGYDGRGFDYWGQGTTVTVSSGGGGSGGGGSSGGGSDIELTQS
PAIMSASPGEKVTMTCSASSSVSYMHWYQQKSGTSPKRWIYDTSKLASGVPGRFSGS
GSGNSYSLTISSVEAEDDATYYCQQWSKHPLTYGAGTKLEIKASPCVGSNPCYNQGTC
EPTSENPFYRCLCPAKFNGLLCHILDYSFTGGAGRDIPPPQIEEACELPECQVDAGNKV
CNLQCNNHACGWDGGDCSLNFNDPWKNCTQSLQCWKYFSDGHCDSQCNSAGCLFD
GFDCQLTEGQCNPLYDQYCKDHFSDGHCDQGCNSAECEWDGLDCAEHVPERLAAGT
LVLVVLLPPDQLRNNSFHFLRELSHVLHTNVVFKRDAQGQQMIFPYYGHEEELRKHPIK
RSTVGWATSSLLPGTSGGRQRRELDPMDIRGSIVYLEIDNRQCVQSSSQCFQSATDVA
AFLGALASLGSLNIPYKIEAVKSEPVEPPLPSQLHLMYVAAAAFVLLFFVGCGVLLSRKR
RRQLCIL PKKKRKVDALDDFDLDMLGSDALDDFDLDMLGSDALDDFDLDMLGSDALDD
FDLDMLGSGGSGGSGGSLEIEAAFLERENTALETRVAELRQRVQRLRNRVSQYRTRY
GPLGGGK*

FIG. 25

Anti-CD19 scFv Chimeric Notch FLPe Recombinase

Underlined Text – signal sequence
Bold Underlined Text – Myc-tag
Dashed Box Text – anti-CD19 scFV
Grey Background Text – Notch Regulatory Region
Dotted Box Text – FLPe MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSLDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRMSQFDILCKTPPKVLVRQFVERFERPSGEKIASCAAELTYLCW
MITHNGTAIKRATFMSYNTIISNSLSFDIVNKSLQFKYKTQKATILEASLKKLIPAWEFTIIP
YNGQKHQSDITDIVSSLQLQFESSEEADKGNSHSKKMLKALLSEGESIWEITEKILNSFE
YTSRFTKTKTLYQFLFLATFINCGRFSDIKNVDPKSFKLVQNKYLGVIIQCLVTETKTSVS
RHIYFFSARGRIDPLVYLDEFLRNSEPVLKRVNRTGNSSSNKQEYQLLKDNLVRSYNKA
LKKNAPYPIFAIKNGPKSHIGRHLMTSFLSMKGLTELTNVVGNWSDKRASAVARTTYTH
QITAIPDHYFALVSRYYAYDPISKEMIALKDETNPIEEWQHIEQLKGSAEGSIRYPAWNGII
SQEVLDYLSSYINRRIGPVEQKLISEEDL*

FIG. 26

Anti-CD19 scFV Chimeric Notch NLS Cre Recombinase

Underlined Text – signal sequence
Bold Underlined Text – Myc-tag
Dashed Box Text – anti-CD19 scFV
Grey Background Text – Notch Regulatory Region
Dotted Box Text – NLS Cre MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSLDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRMVPKKKRKVSNLLTVHQNLPALPVDATSDEVRKNLMDMFRD
RQAFSEHTWKMLLSVCRSWAAWCKLNNRKWFPAEPEDVRDYLLYLQARGLAVKTIQQ
HLGQLNMLHRRSGLPRPSDSNAVSLVMRRIRKENVDAGERAKQALAFERTDFDQVRS
LMENSDRCQDIRNLAFLGIAYNTLLRIAEIARIRVKDISRTDGGRMLIHIGRTKTLVSTAGV
EKALSLGVTKLVERWISVSGVADDPNNYLFCRVKNGVAAPSATSQLSTRALEGIFEAT
HRLIYGAKDDSGQRYLAWSGHSARVGAARDMARAGVSIPEIMQAGGWTNVNIVMNYI
RNLDSETGAMVRLLEDGD*

FIG. 27

Anti-CD19 scFv Chimeric Notch MyoD RFP

Underlined Text – signal sequence
Bold Underlined Text – Myc-tag
Dashed Box Text – anti-CD19 scFV
Grey Background Text – Notch Regulatory Region
Dotted Box Text – MyoD RFP MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSILDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQLHLMYVAAAAFVL
LFFVGCGVLLSRKRRRMELLSPPLRDIDLTGPDGSLCSFETADDFYDDPCFDSPDLRFF
EDLDPRLVHMGALLKPEEHAHFPTAVHPGPGAREDEHVRAPSGHHQAGRCLLWACKA
CKRKTTNADRRKAATMRERRRLSKVNEAFETLKRCTSSNPNQRLPKVEILRNAIRYIEG
LQALLRDQDAAPPGAAAFYAPGPLPPGRGSEHYSGDSDASSPRSNCSDGMMDYSGP
PSGPRRQNGYDTAYYSEAARESRPGKSAAVSSLDCLSSIVERISTDSPAAPALLLADAP
PESPPGPPEGASLSDTEQGTQTPSPDAAPQCPAGSNPNAIYQVLGGGSGGGSGGGS
MVSKGEELIKENMHMKLYMEGTVNNHHFKCTSEGEGKPYEGTQTMRIKVVEGGPLPF
AFDILATSFMYGSRTFINHTQGIPDFFKQSFPEGFTWERVTTYEDGGVLTATQDTSLQD
GCLIYNVKIRGVNFPSNGPVMQKKTLGWEANTEMLYPADGGLEGRTDMALKLVGGGH
LICNFKTTYRSKKPAKNLKMPGVYYVDHRLERIKEADKETYVEQHEVAVARYCDLPSKL
GHKLNGMDELYK*

FIG. 28

Anti-CD19 scFV Chimeric Notch Tbet

Underlined Text – signal sequence
Bold Underlined Text – Myc-tag
Dashed Box Text – anti-CD19 scFV
Grey Background Text – Notch Regulatory Region
Dotted Box Text – Tbx21 aka Tbet (BC039739)

MALPVTALLLPLALLLHAARPEQKLISEEDLDIQMTQTTSSLSASLGDRVTISCRASQDIS
KYLNWYQQKPDGTVKLLIYHTSRLHSGVPSRFSGSGSGTDYSLTISNLEQEDIATYFCQ
QGNTLPYTFGGGTKLEITGGGGSGGGGSGGGGSEVKLQESGPGLVAPSQSLSVTCTV
SGVSLPDYGVSWIRQPPRKGLEWLGVIWGSETTYYNSALKSRLTIIKDNSKSQVFLKMN
SLQTDDTAIYYCAKHYYYGGSYAMDYWGQGTSVTVSSLDYSFTGGAGRDIPPPQIEEA
CELPECQVDAGNKVCNLQCNNHACGWDGGDCSLNFNDPWKNCTQSLQCWKYFSDG
HCDSQCNSAGCLFDGFDCQLTEGQCNPLYDQYCKDHFSDGHCDQGCNSAECEWDG
LDCAEHVPERLAAGTLVLVVLLPPDQLRNNSFHFLRELSHVLHTNVVFKRDAQGQQMIF
PYYGHEEELRKHPIKRSTVGWATSSLLPGTSGGRQRRELDPMDIRGSIVYLEIDNRQCV
QSSSQCFQSATDVAAFLGALASLGSLNIPYKIEAVKSEPVEPPLPSQHLMYVAAAAFVL
LFFVGCGVLLSRKRRRMGIVEPGCGDMLTGTEPMPGSDEGRAPGADPQHRYFYPEP
GAQDADERRGGGSLGSPYPGGALVPAPPSRFLGAYAYPPRPQAAGFPGAGESFPPP
ADAEGYQPGEGYAAPDPRAGLYPGPREDYALPAGLEVSGKLRVALNNHLLWSKFNQH
QTEMIITKQGRRMFPFLSFTVAGLEPTSHYRMFVDVVLVDQHHWRYQSGKWVQCGKA
EGSMPGNRLYVHPDSPNTGAHWMRQEVSFGKLKLTNNKGASNNVTQMIVLQSLHKY
QPRLHIVEVNDGEPEAACNASNTHIFTFQETQFIAVTAYQNAEITQLKIDNNPFAKGFRE
NFESMYTSVDTSIPSPPGPNCQFLGGDHYSPLLPNQYPVPSRFYPDLPGQAKDVVPQA
YWLGAPRDHSYEAEFRAVSMKPAFLPSAPGPTMSYYRGQEVLAPGAGWPVAPQYPP
KMGPASWFRPMRTLPMEPGPGGSEGRGPEDQGPPLVWTEIAPIRPESSDSGLGEGD
SKRRRVSPYPSSGDSSSPAGAPSPFDKEAEGQFYNYFPN*

FIG. 29

CD4 Notch Minimal Regulatory Region Domain tTA

Underlined Text – signal sequence
Dashed Box Text – Homo sapiens CD4 extracellular domain
Grey Background Text – Minimal Notch Regulatory Region
Dotted Box Text – tTA MNRGVPFRHLLLVLQLALLPAATQGKKVVLGKKGDTVELTCTASQKKSIQFHWKNSNQI
KILGNQGSFLTKGPSKLNDRADSRRSLWDQGNFPLIIKNLKIEDSDTYICEVEDQKEEVQL
LLVFGLTANSDTHLLQGQSLTLTLESPPGSSPSVQCRSPRGKNIQGGKTLSVSQLELQD
SGTWTCTVLQNQKKVEFKIDIVVLAFQKASSIVYKKEGEQVEFSFPLAFTVEKLTGSGEL
WWQAERASSSKSWITFDLKNKEVSVKRVTQDPKLQMGKKLPLHLTLPQALPQYAGSG
NLTLALEAKTGKLHQEVNLVVMRATQLQKNLTCEVWGPTSPKLMLSLKLENKEAKVSK
REKAVWVLNPEAGMWQCLLSDSGQVLLESNIKVLPTWSTPVQPMIPYKIEAVKSEPVE
PPLPSQLHLMYVAAAAFVLLFFVGCGVLLSRKRRRQLCIQKLMSRLDKSKVINSALELLN
EVGIEGLTTRKLAQKLGVEQPTLYWHVKNKRALLDALAIEMLDRHHTHFCPLEGESWQ
DFLRNNAKSFRCALLSHRDGAKVHLGTRPTEKQYETLENQLAFLCQQGFSLENALYAL
SAVGHFTLGCVLEDQEHQVAKEERETPTTDSMPPLLRQAIELFDHQGAEPAFLFGLELII
CGLEKQLKCESGGPADALDDFDLDMLPADALDDFDLDMLPADALDDFDLDMLPG* activation of transcription with anti-CD19/tTA chimeric Notch activation of transcription with anti-mesothelin/tTA chimeric Notch activation of transcription with anti-CD19/GAL4 chimeric Notch transcription inhibition with anti-CD19/Gal4-KRAB chimeric Notch FIG. 38C
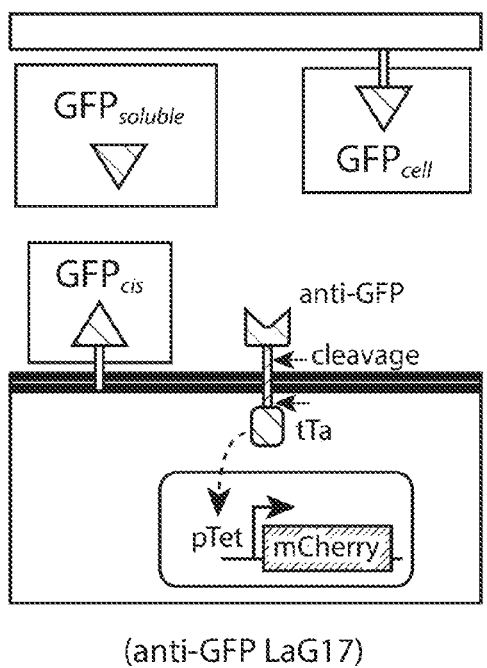
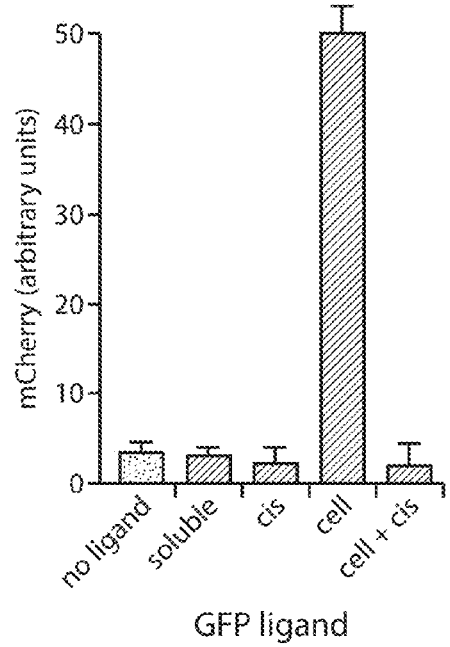
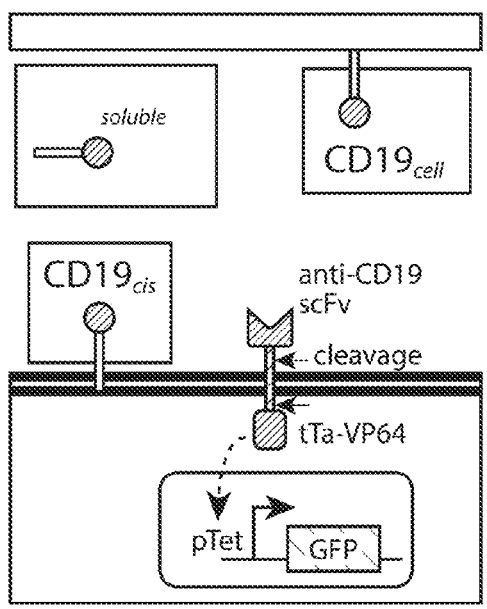
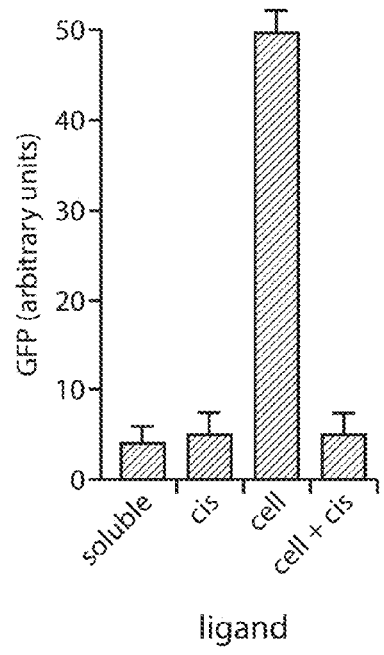

FIG. 39C
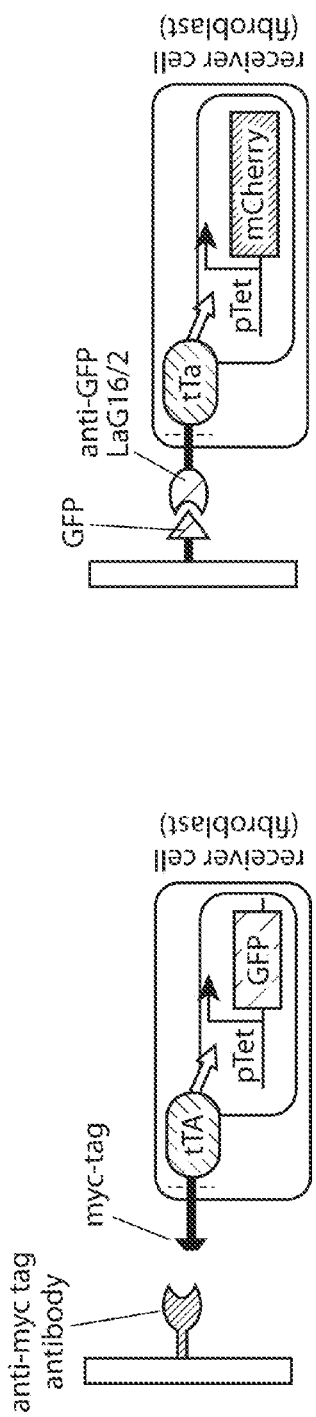
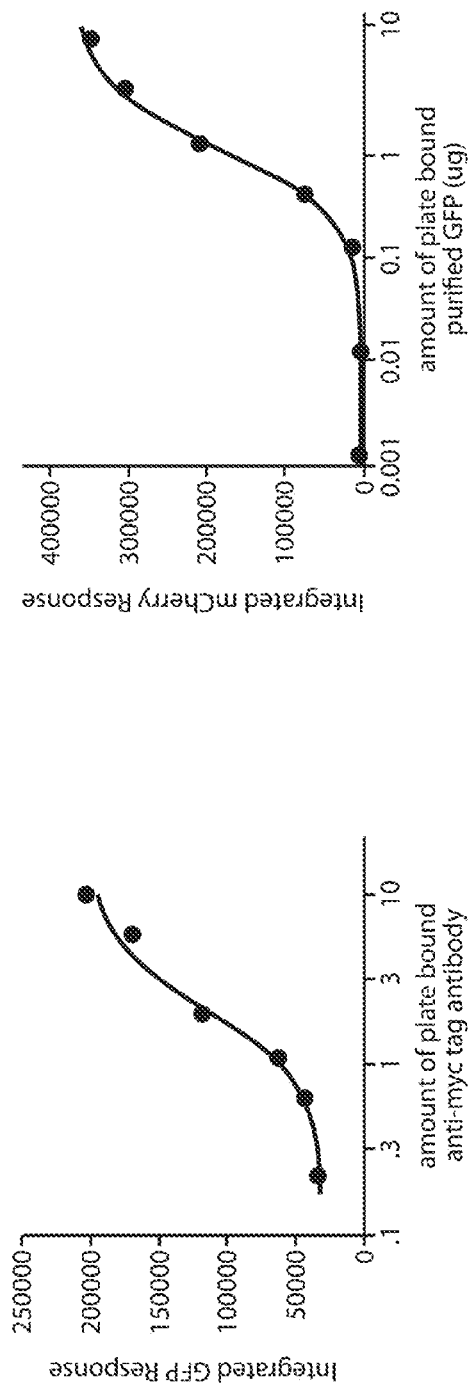

FIG. 40B
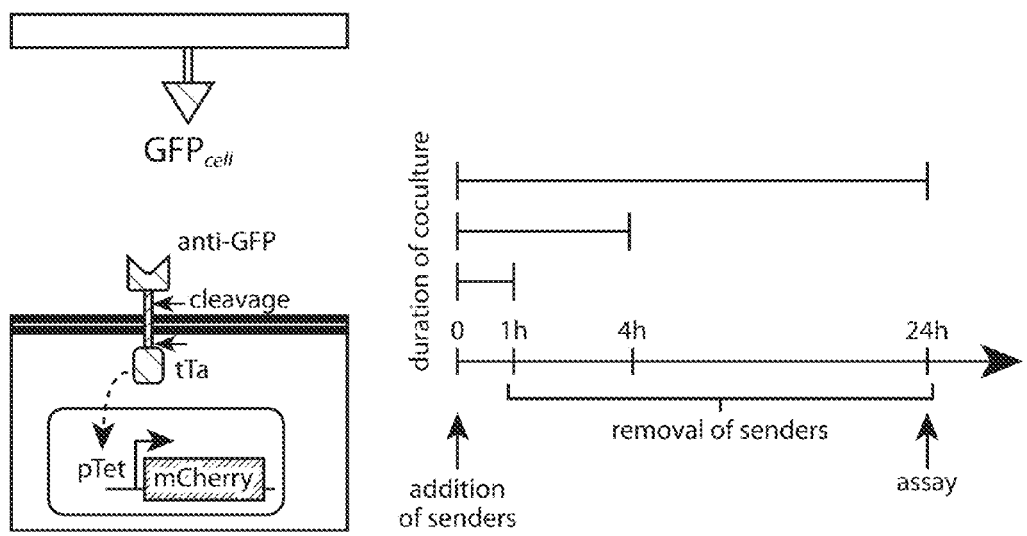
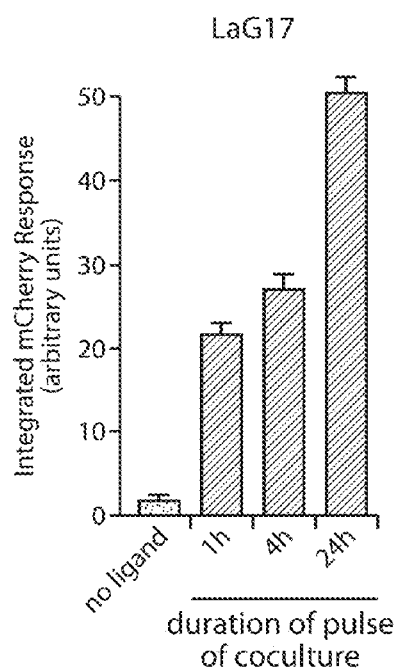
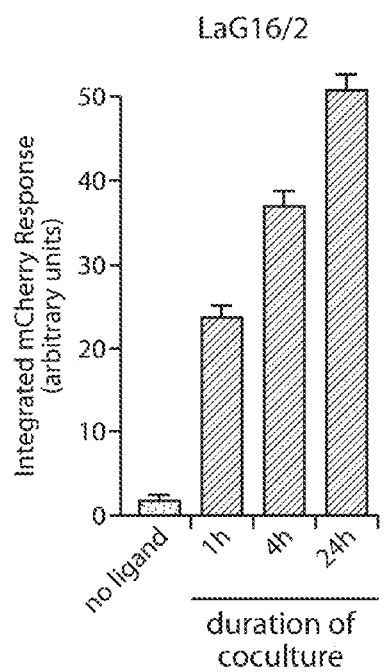

FIG. 40C
FACS plots of CIS-inhibition
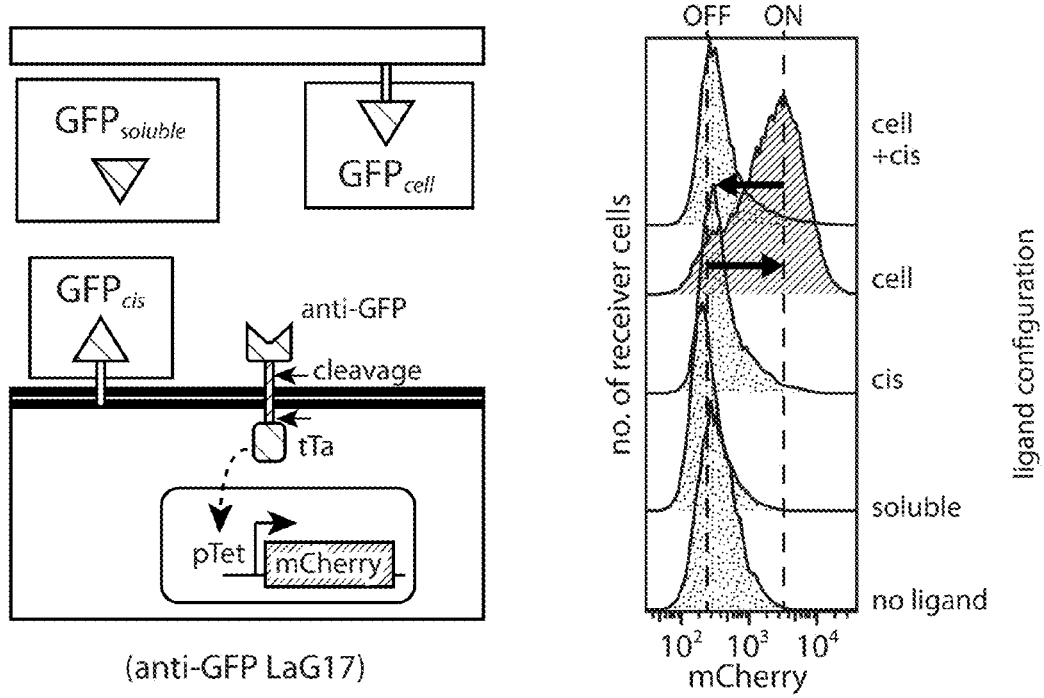
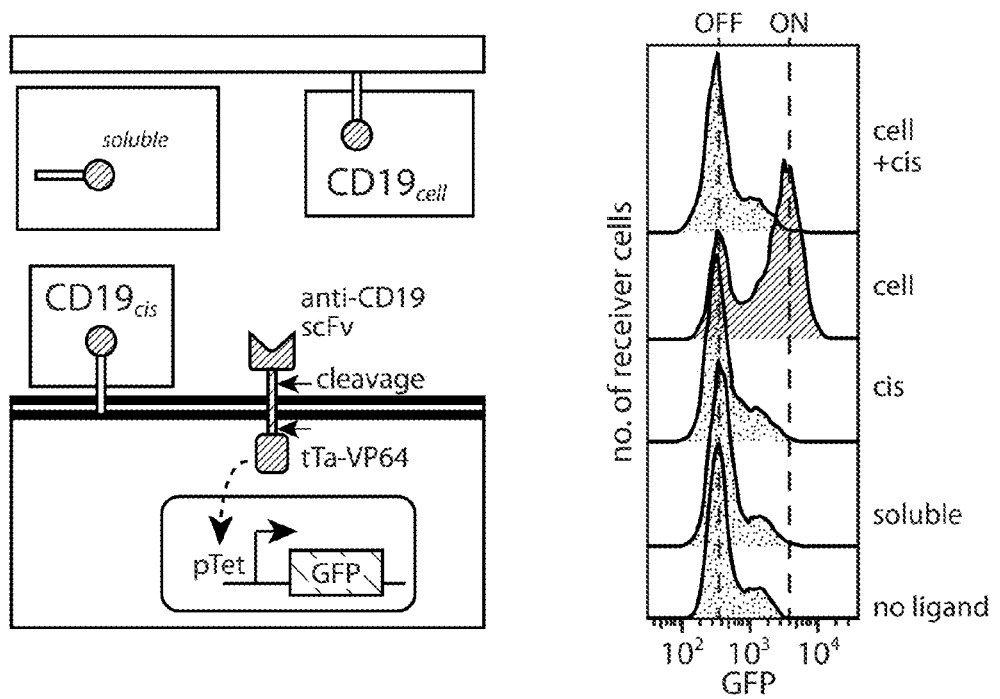

FIG. 41A
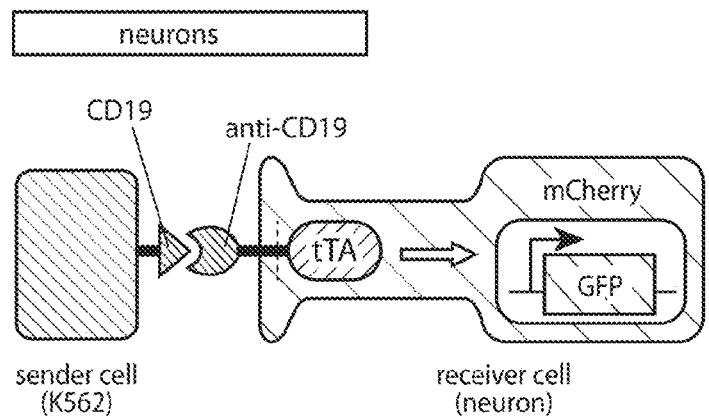
co-plate E18 rat hippocampal neurons with CD19+ or CD19- K562 cells (3 days)
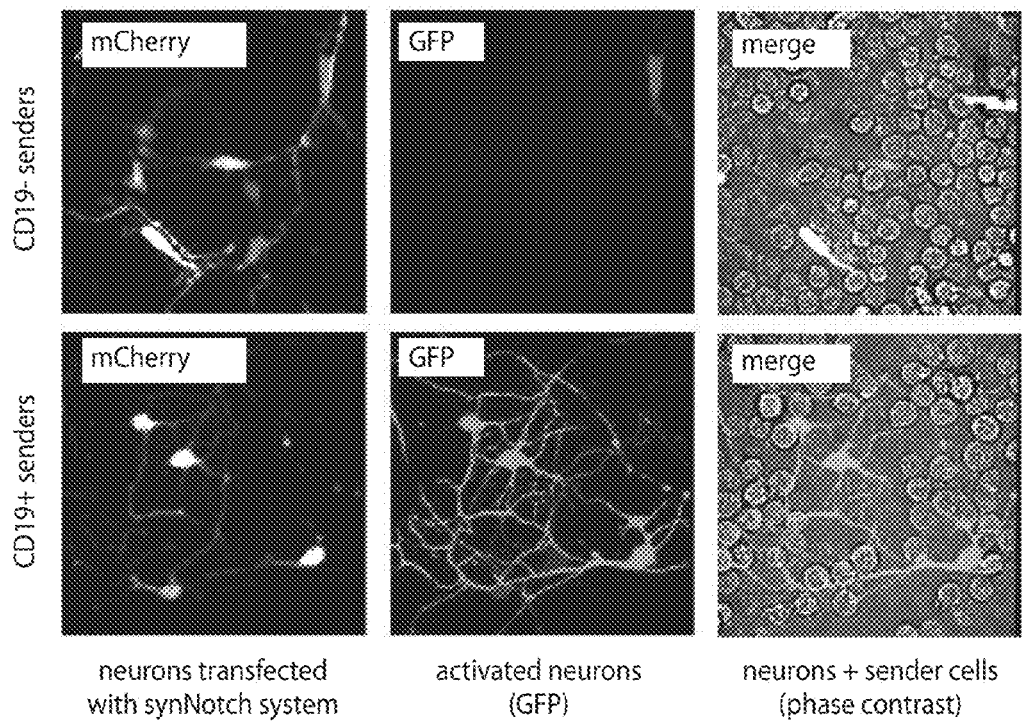

FIG. 41B
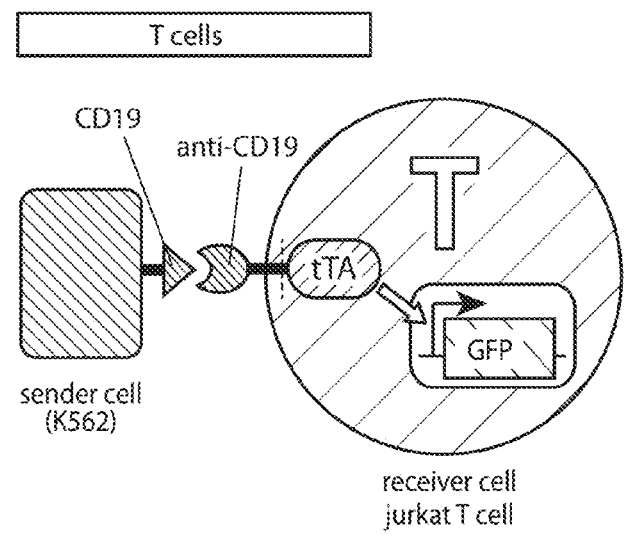
co-culture jurkat T cells with CD19+ or CD19- K562 cells (24 hrs)
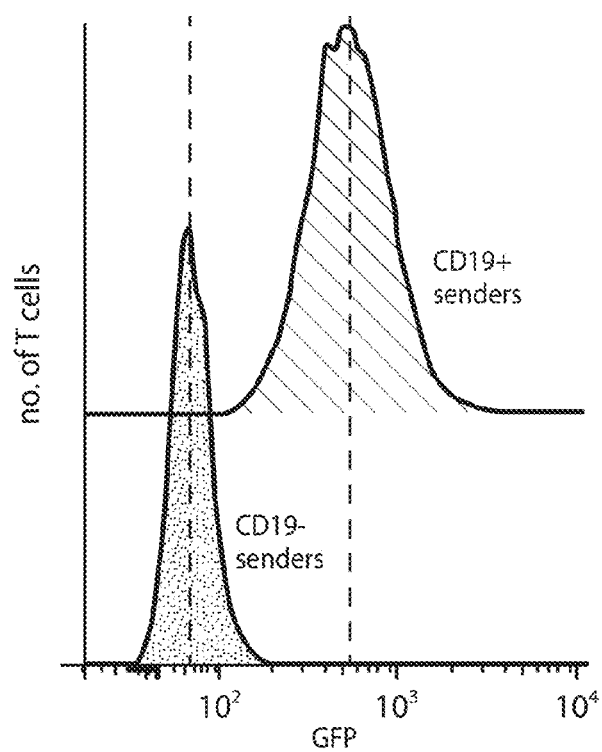

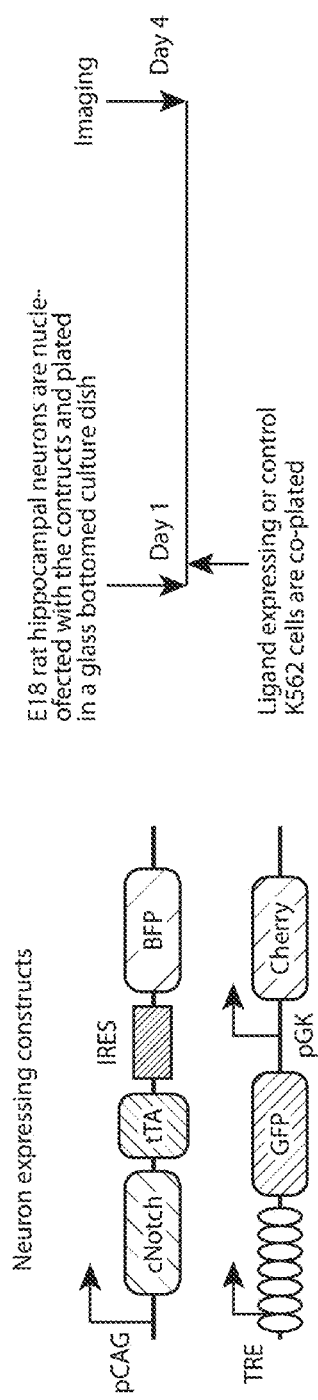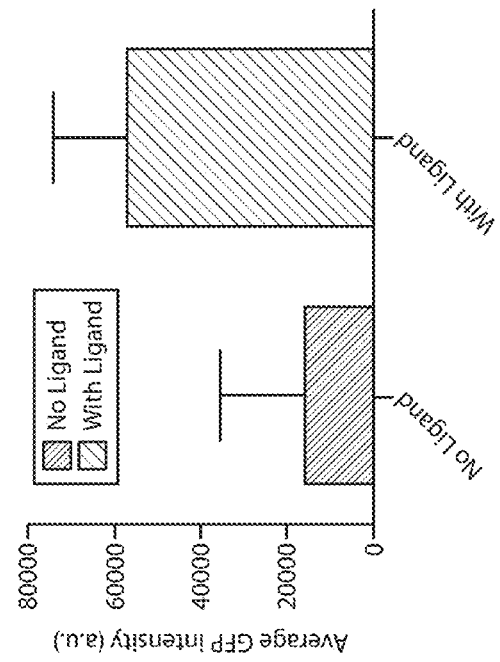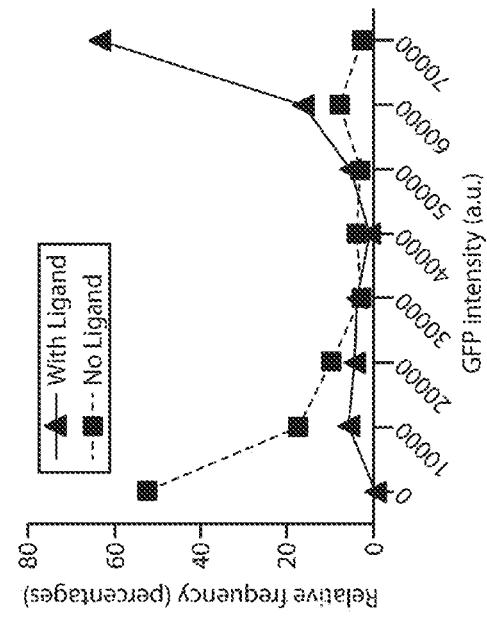

FIG. 43B
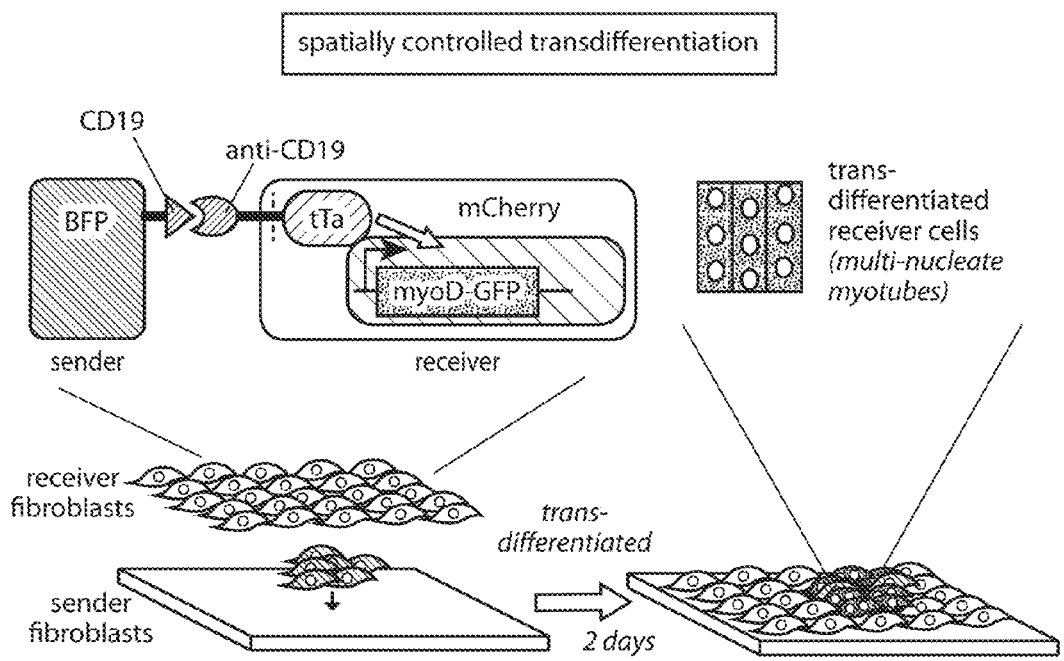
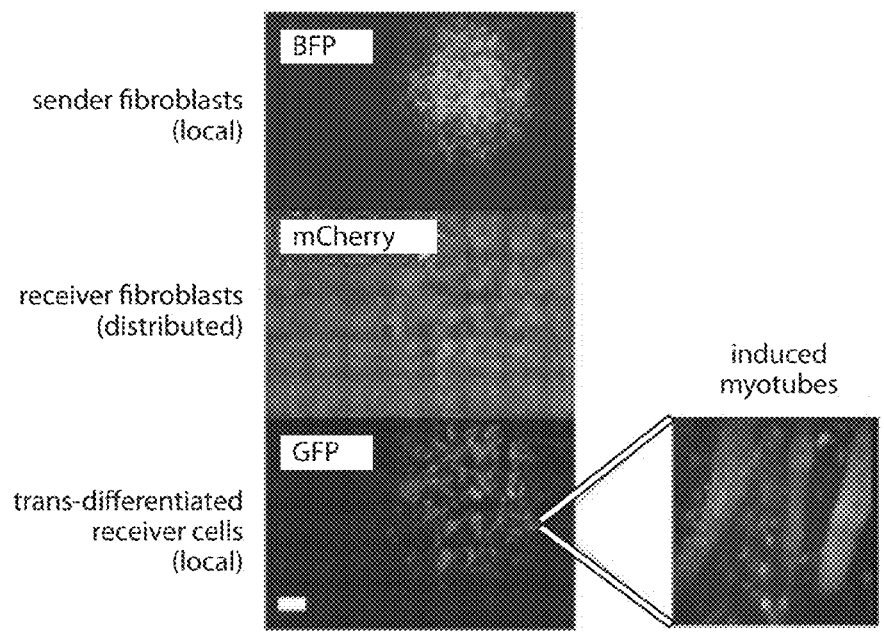

FIG. 44B
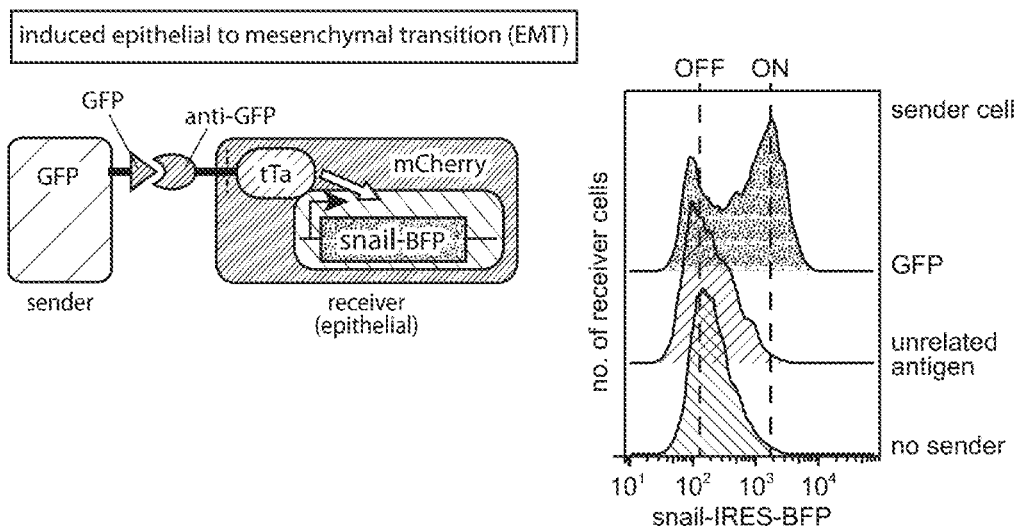
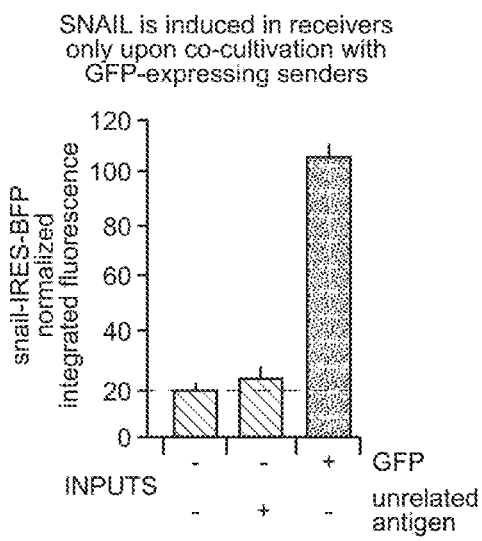
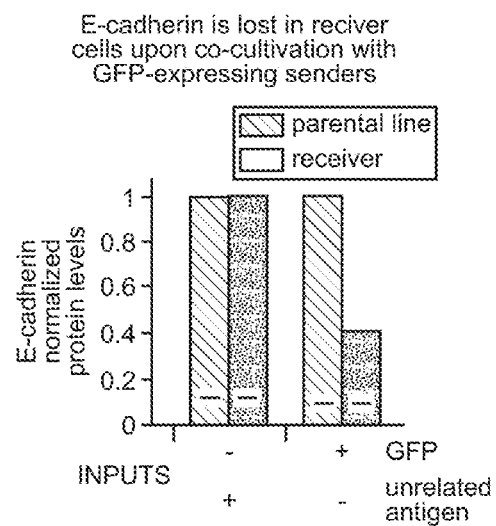

FIG. 45A
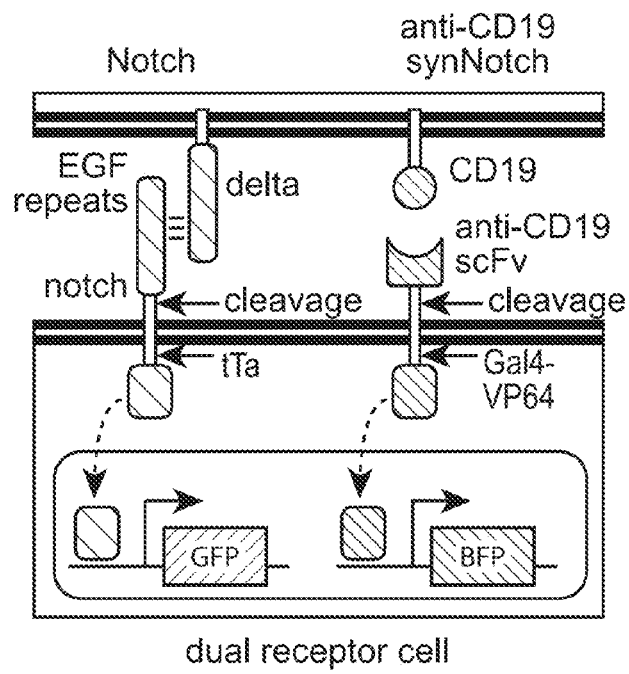
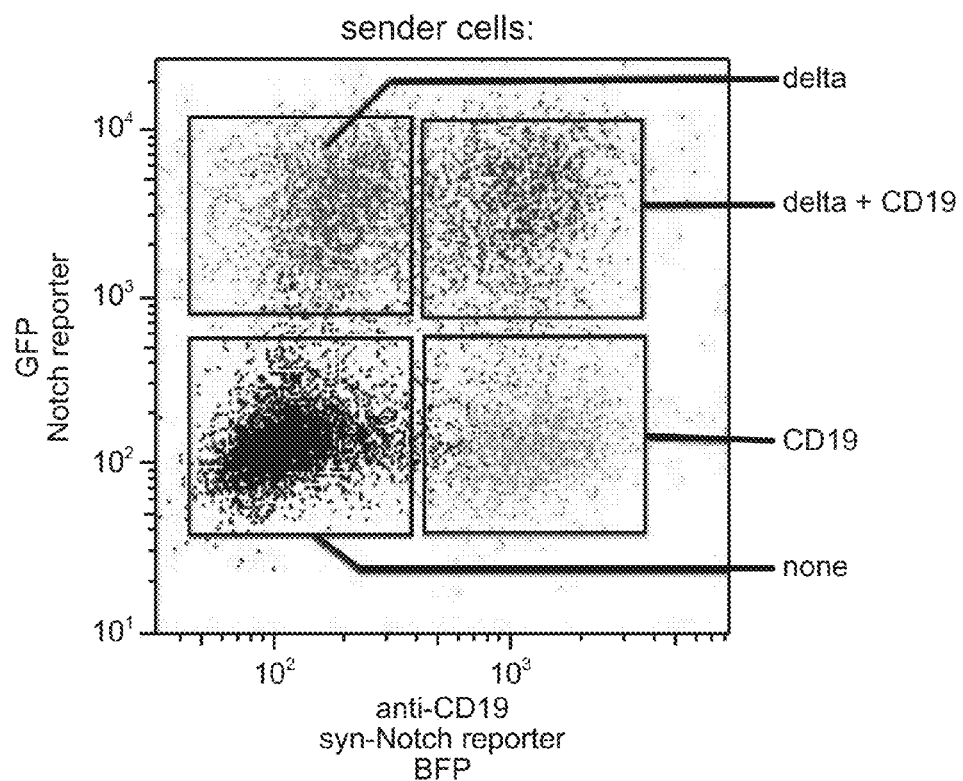

FIG. 45B
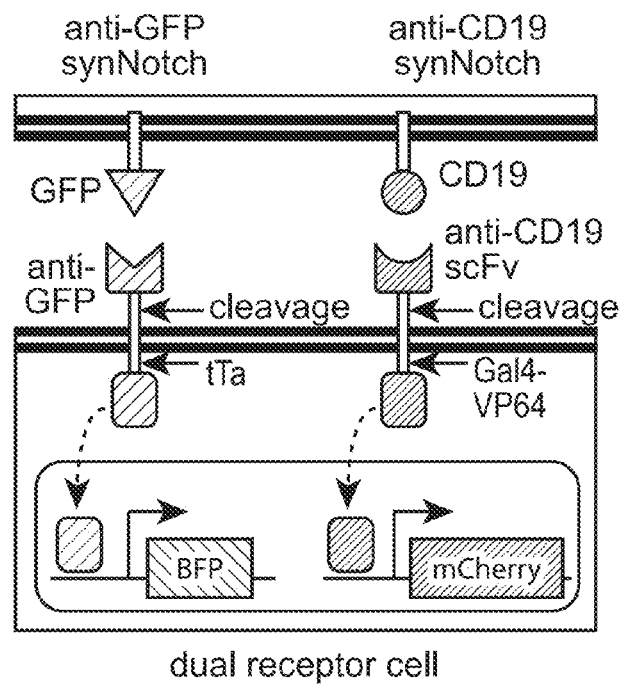
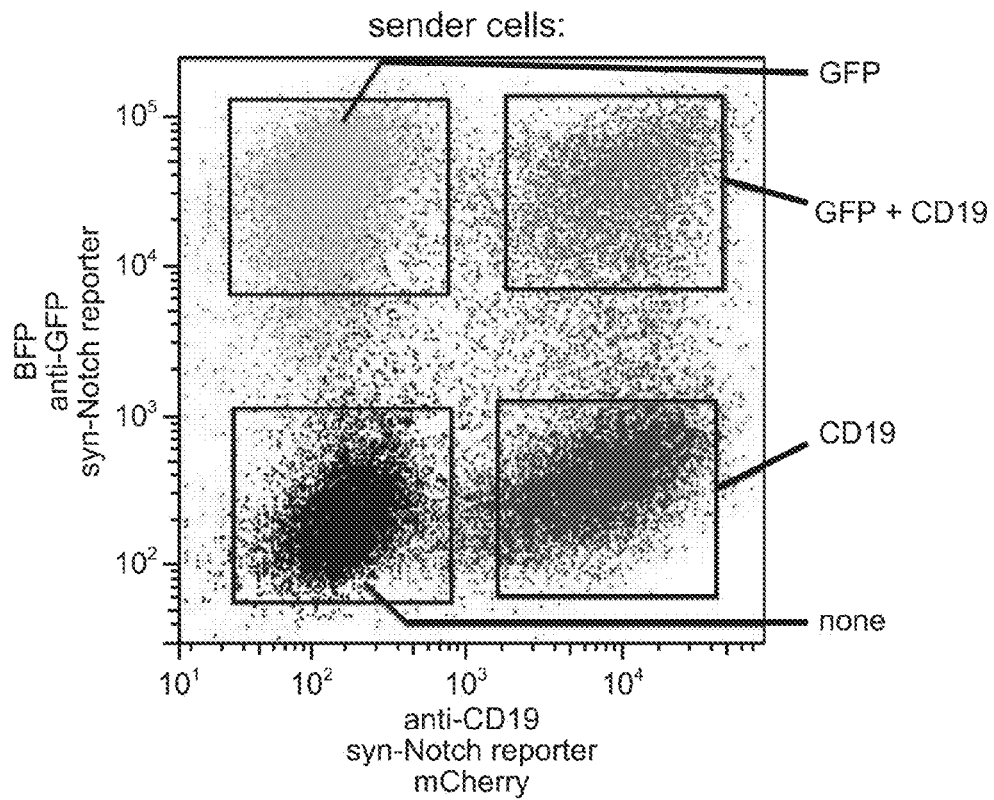

FIG. 45C
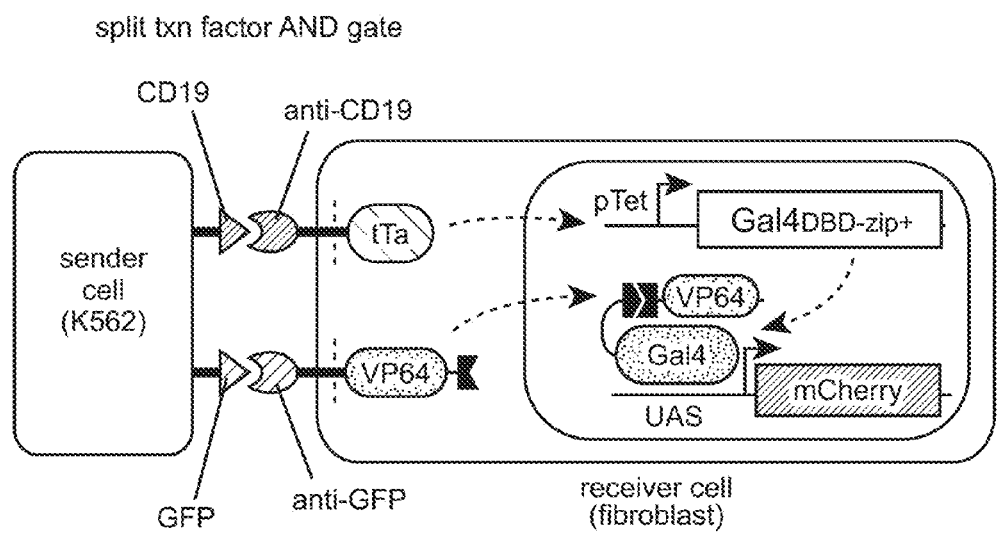
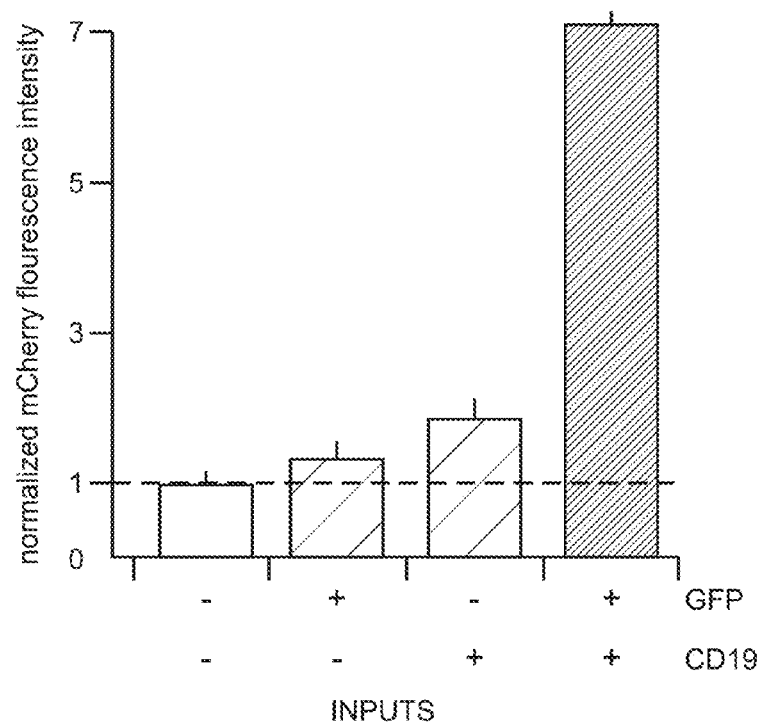

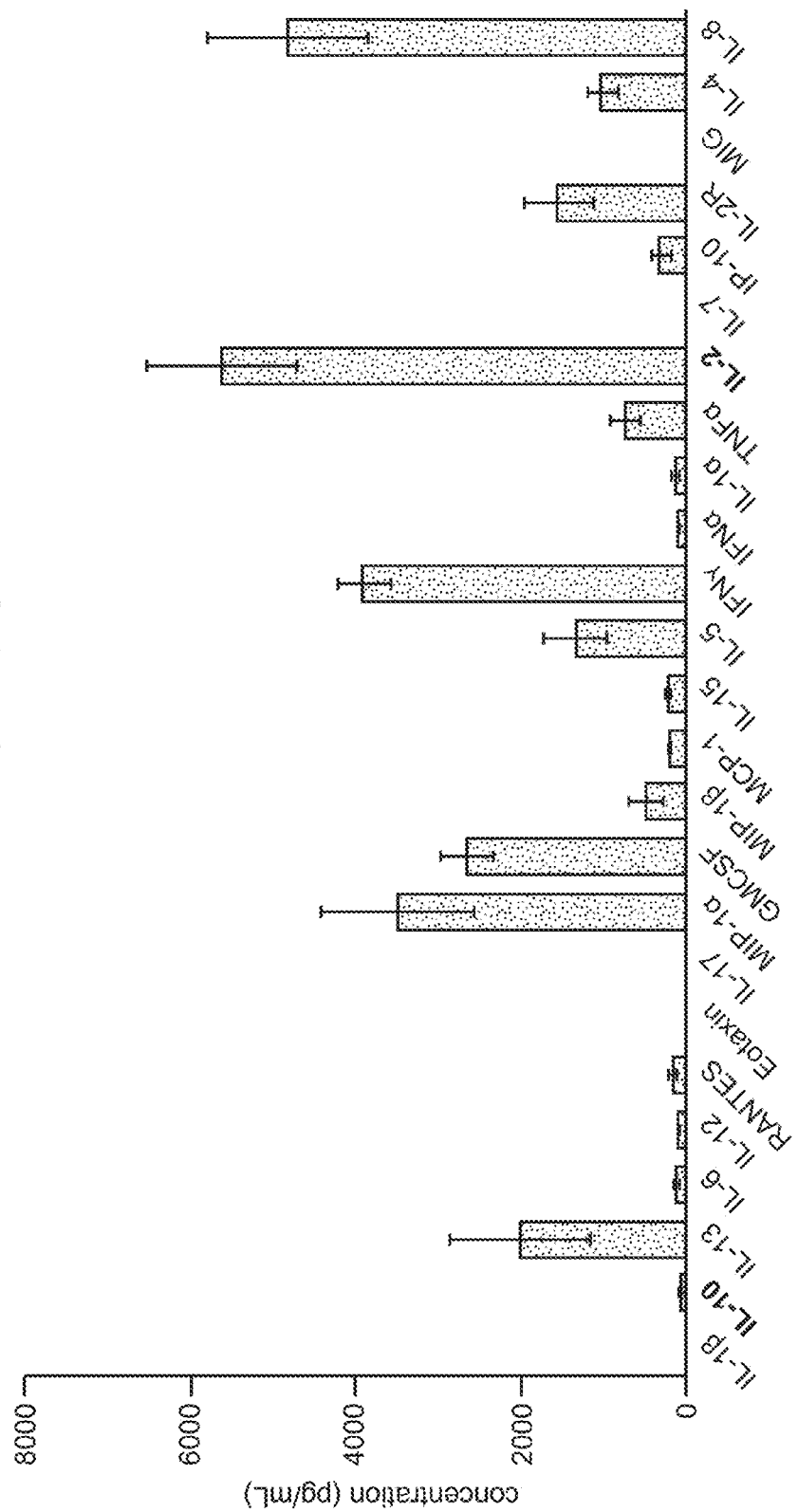

FIG. 51E
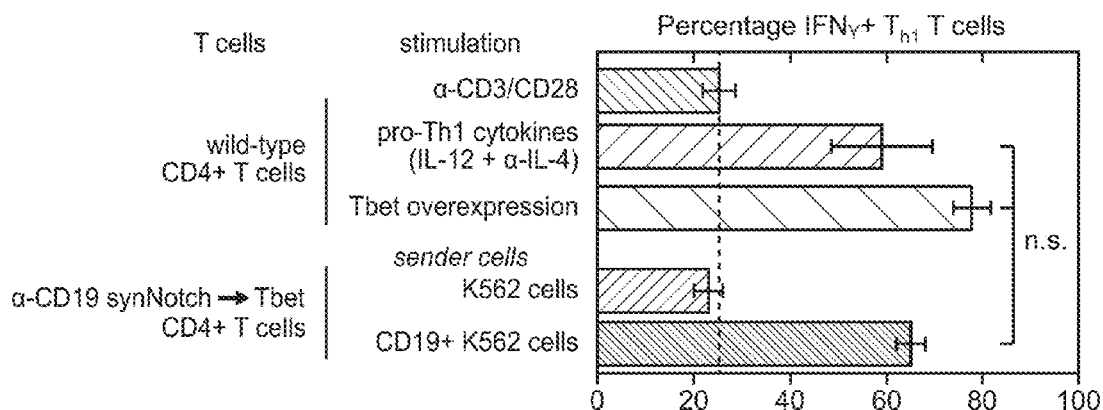
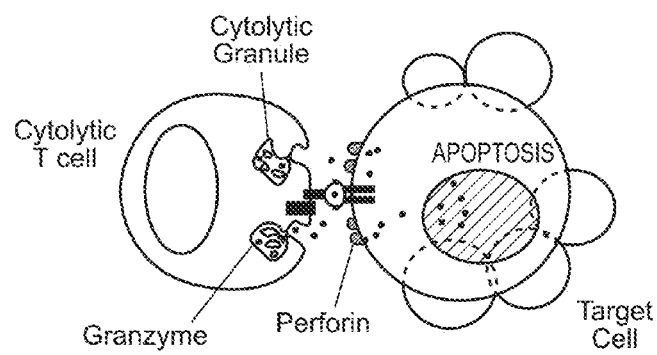
FIG. 52A
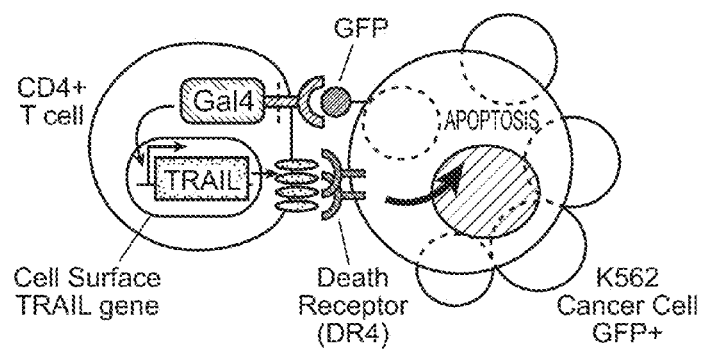
FIG. 52B

Human T cells Do Not Express TRAIL in Response to T cell Activation

Cancer Cells Vary in Their Suceptibility to TRAIL

FIG. 58E
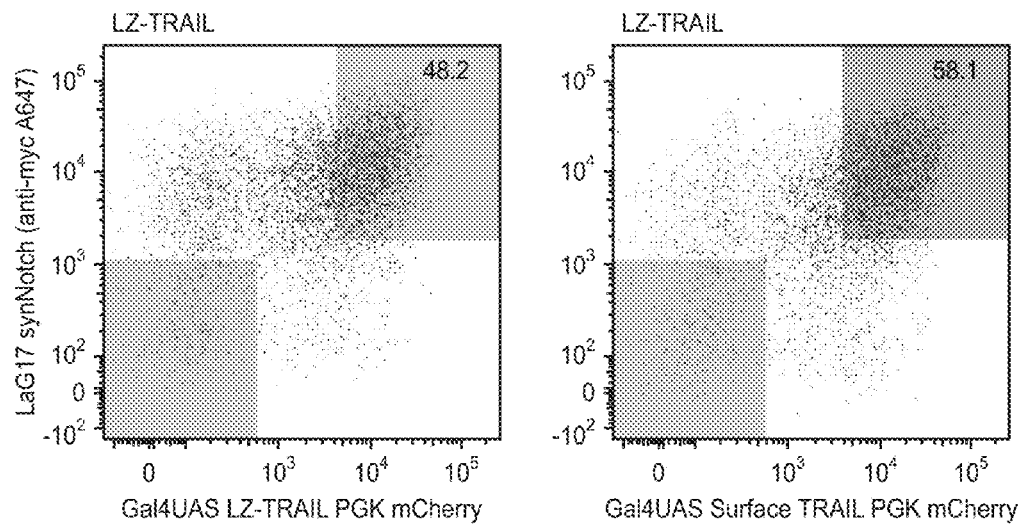
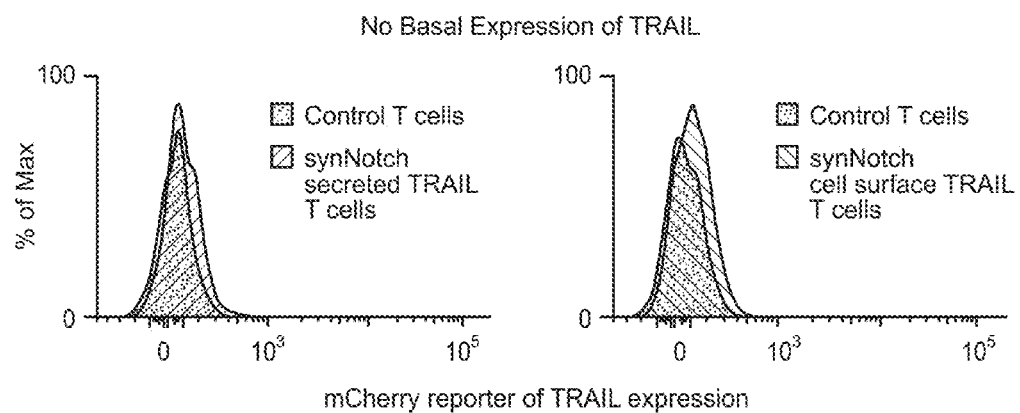

α-CD19 synNotch Gal4VP64 T cells with 5xGal4UAS IL-2 IRES mCherry PGK tBFP

*In vitro* activation of α-CD19 synNotch → IL-2 T cells is Similar to the *In vivo* Activation FIG. 59C
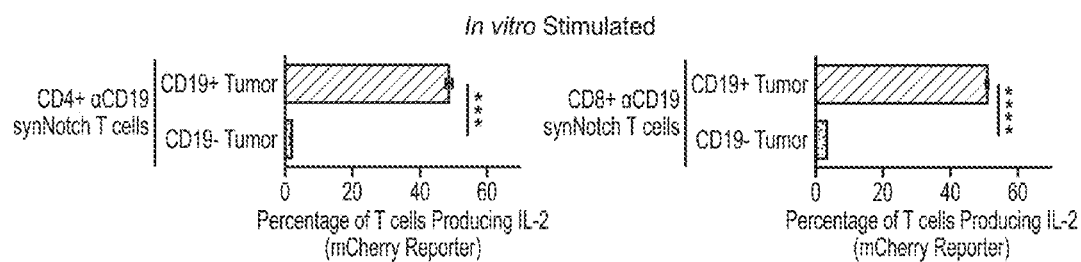
FIG. 59D
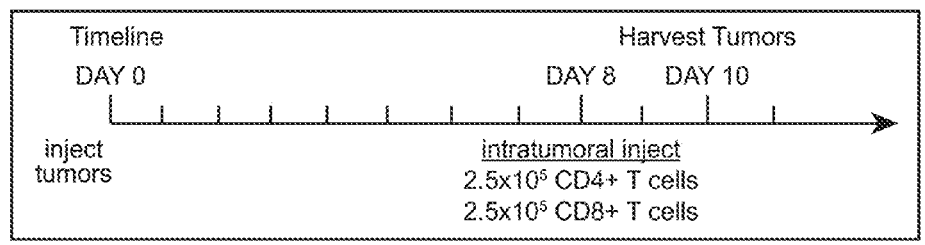
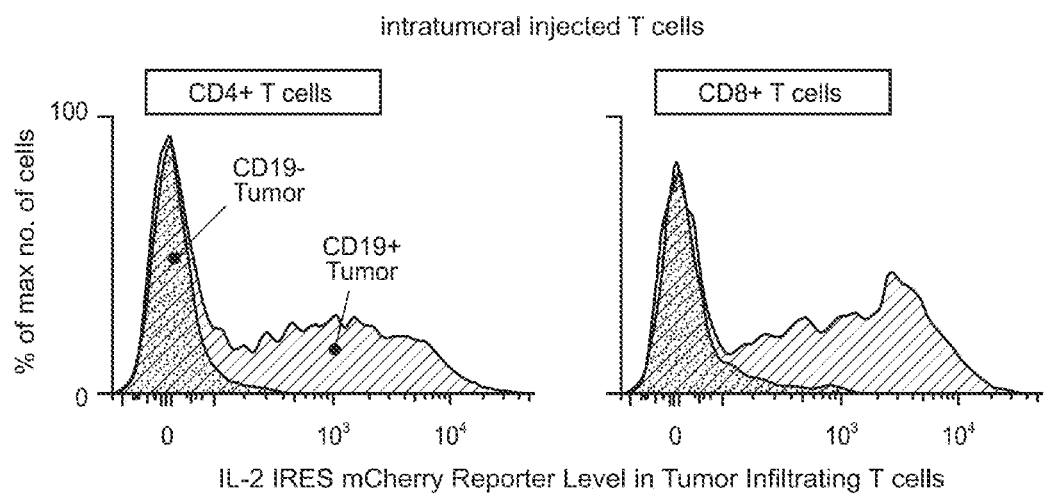

two antigen tumor recognition circuit: synNotch primes CAR expression tumor antigens

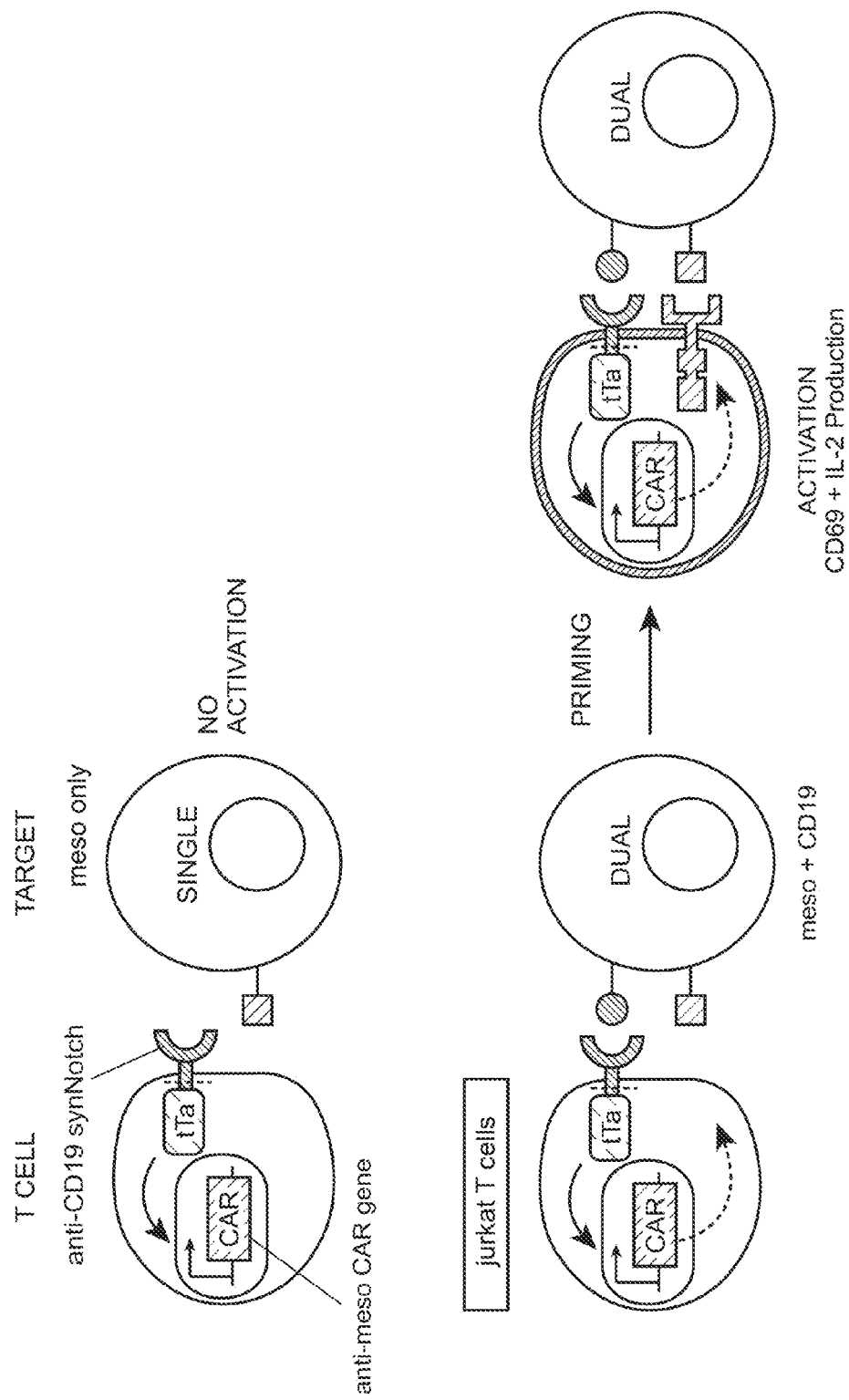

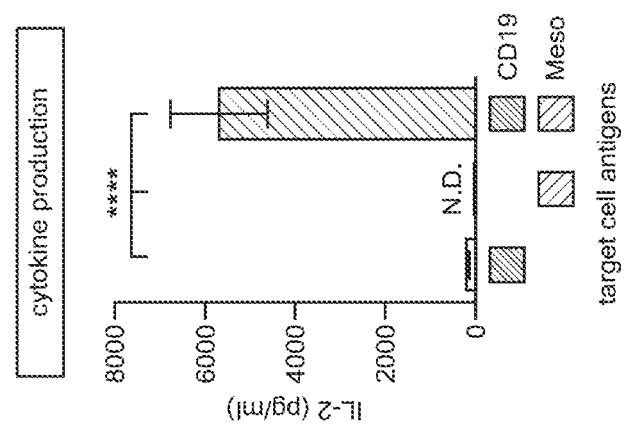
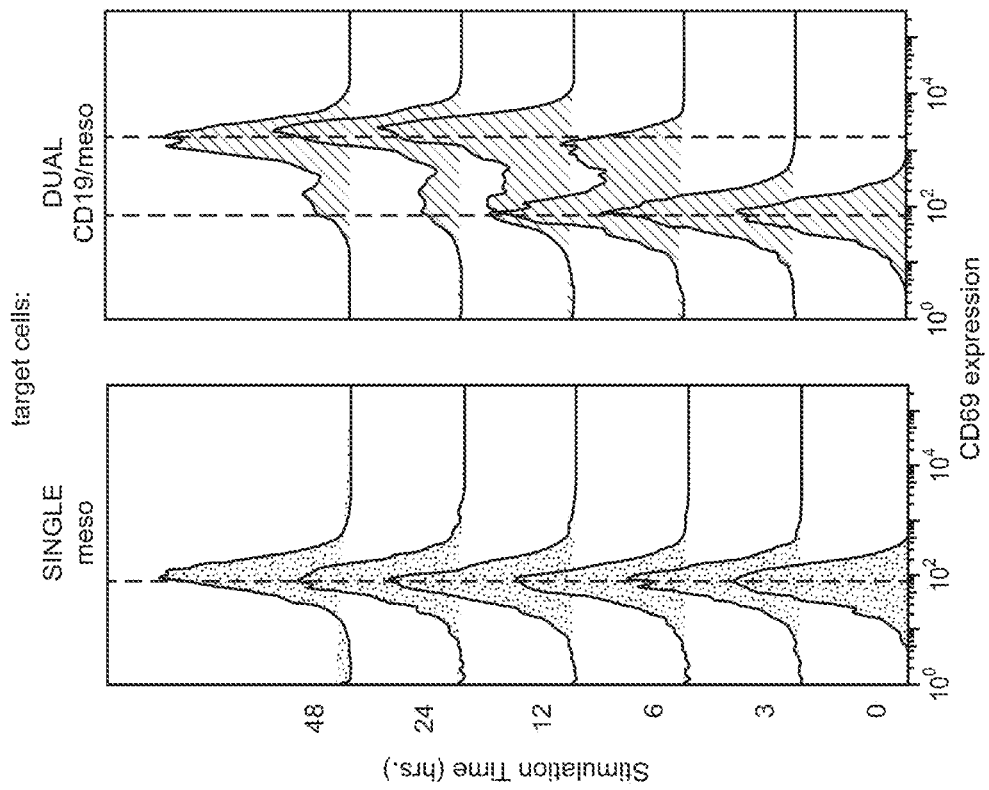

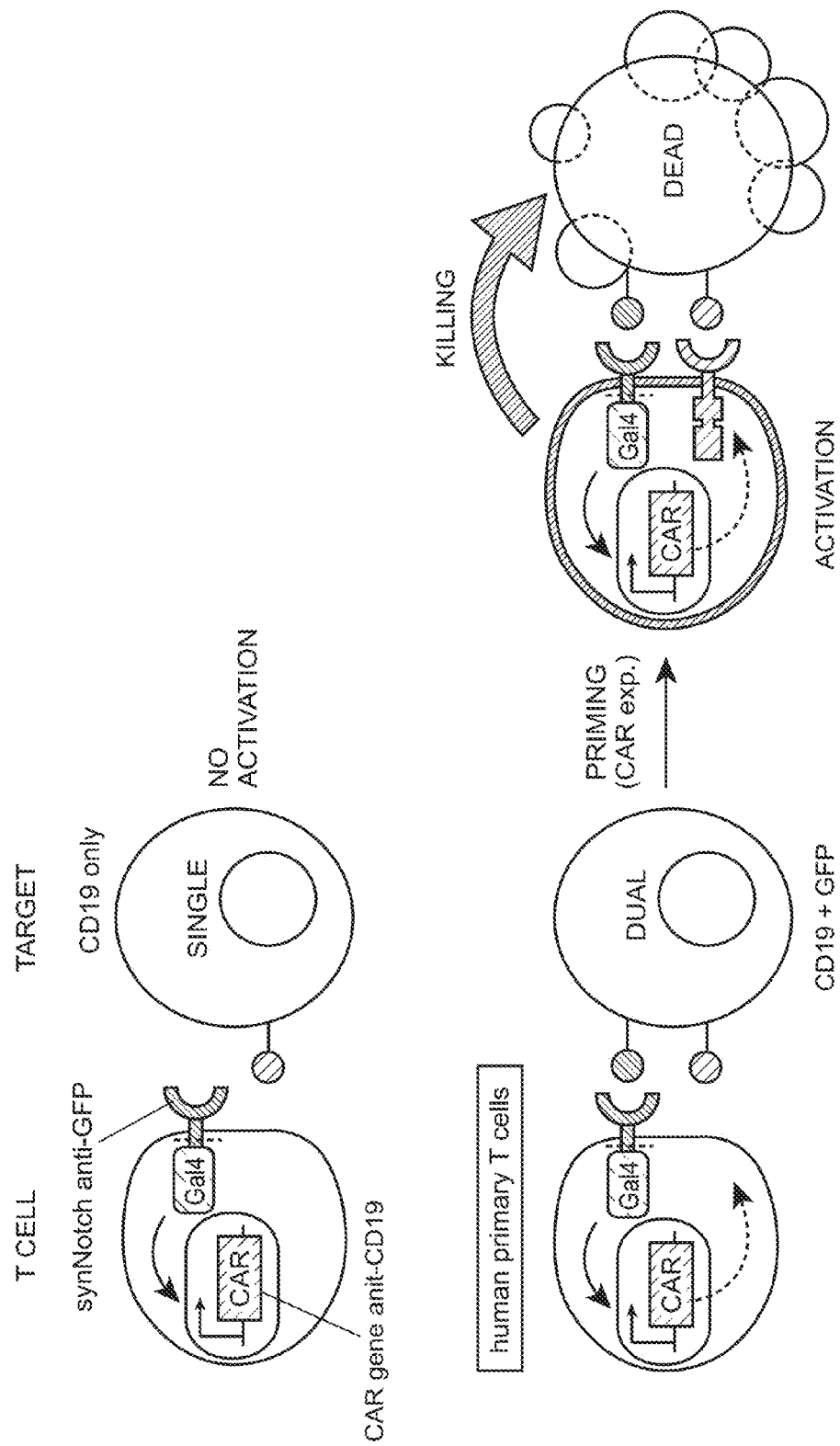

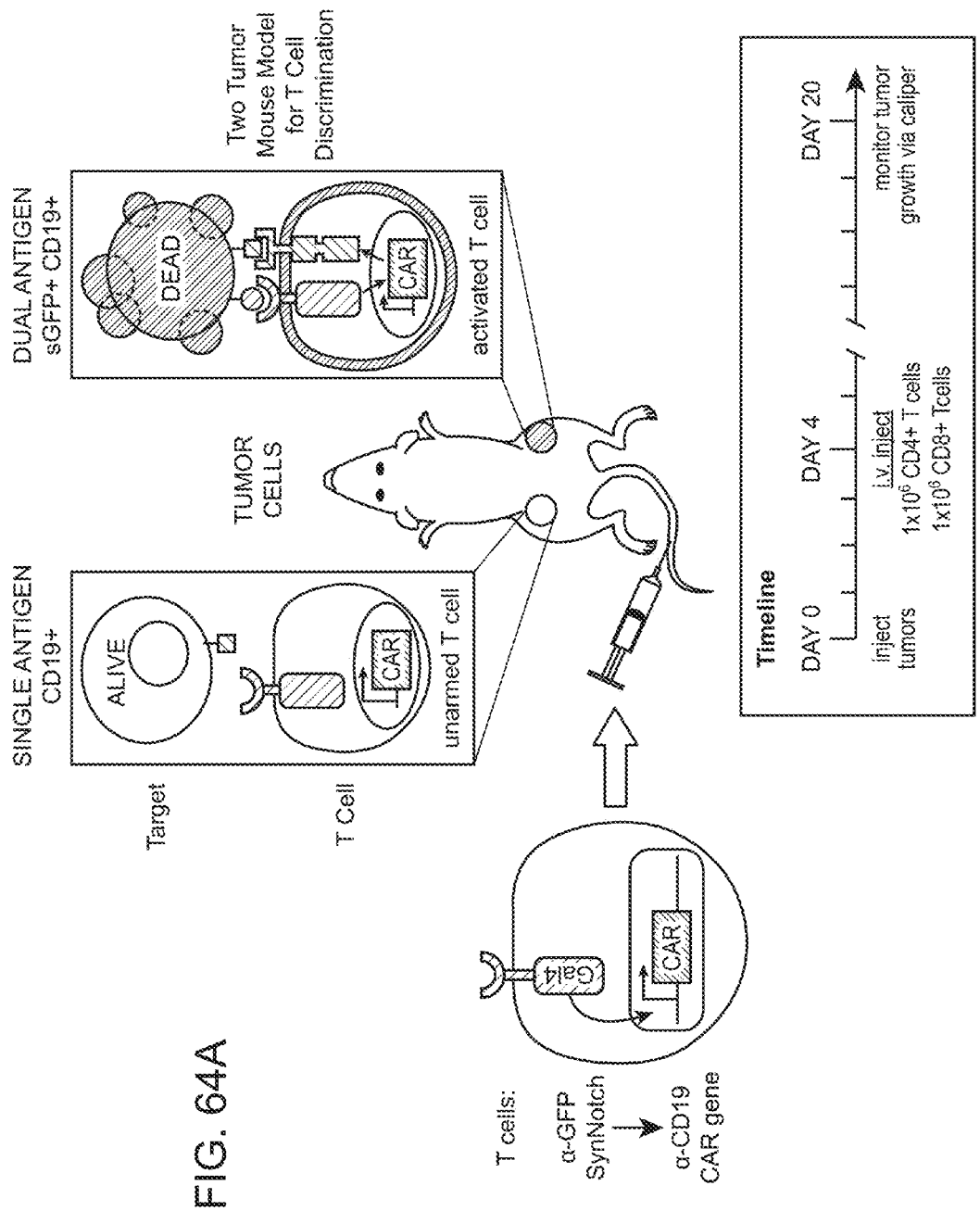

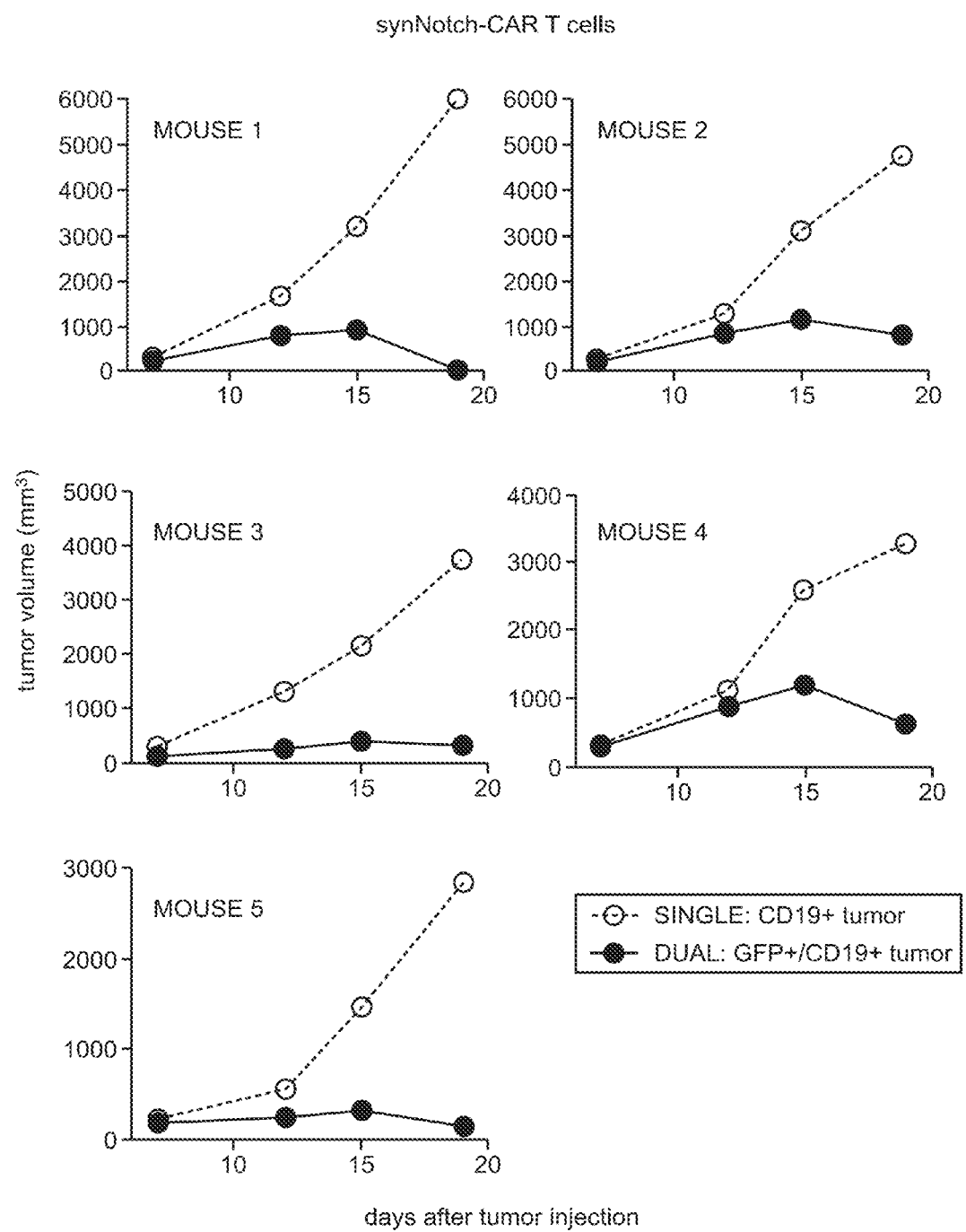

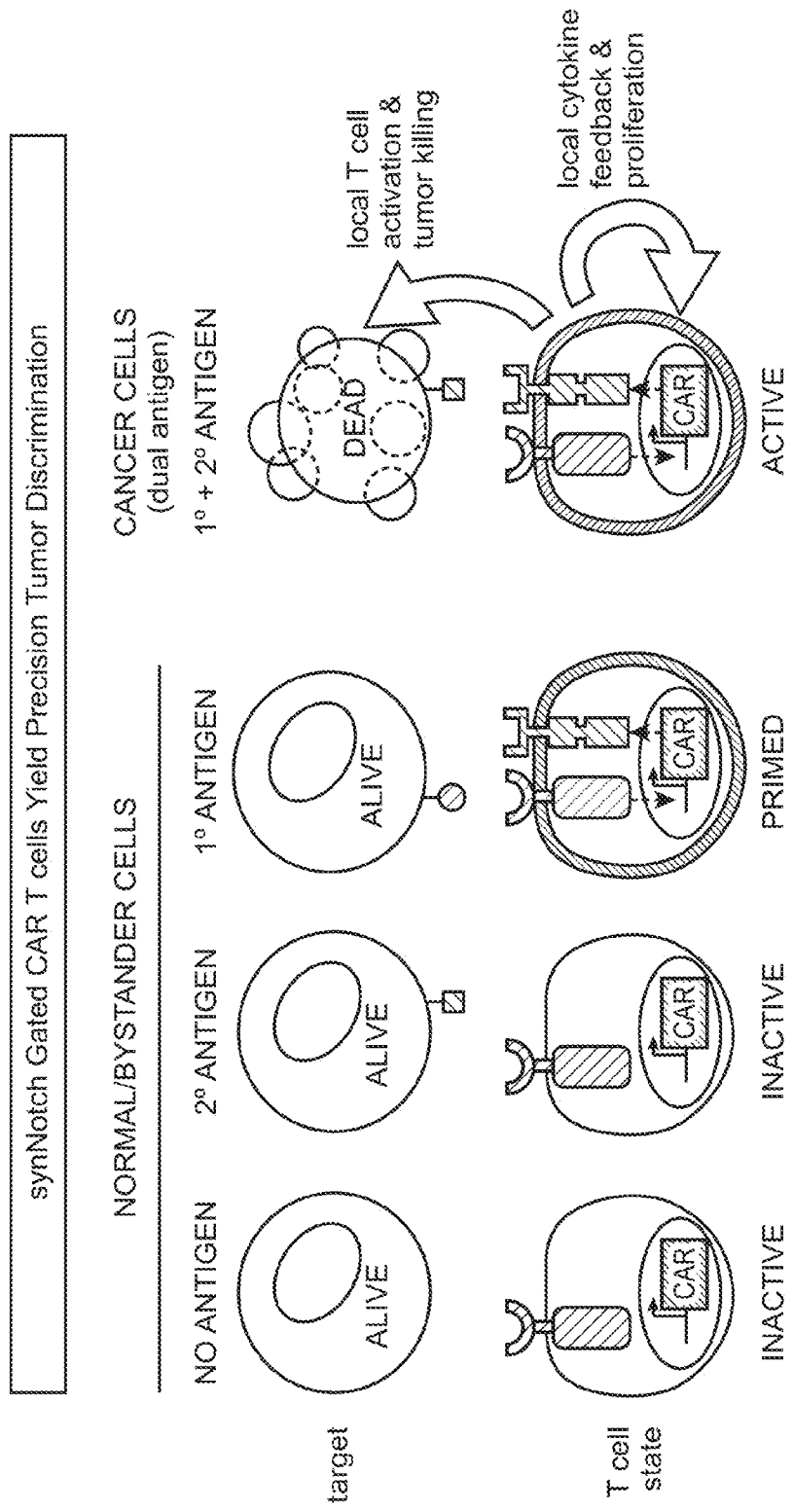

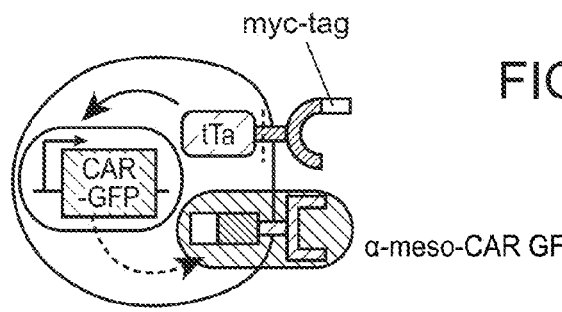
FIG. 66C
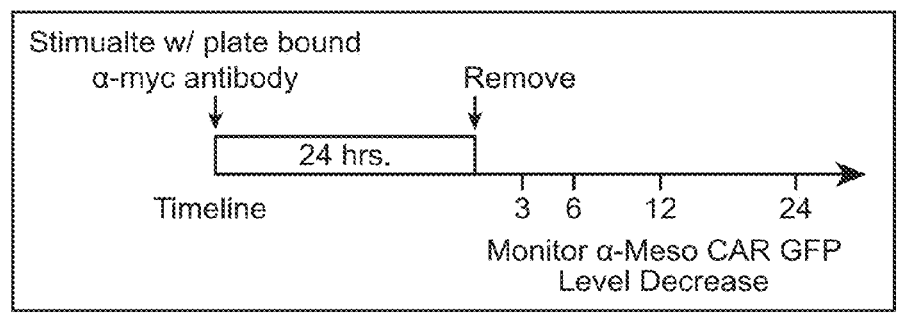
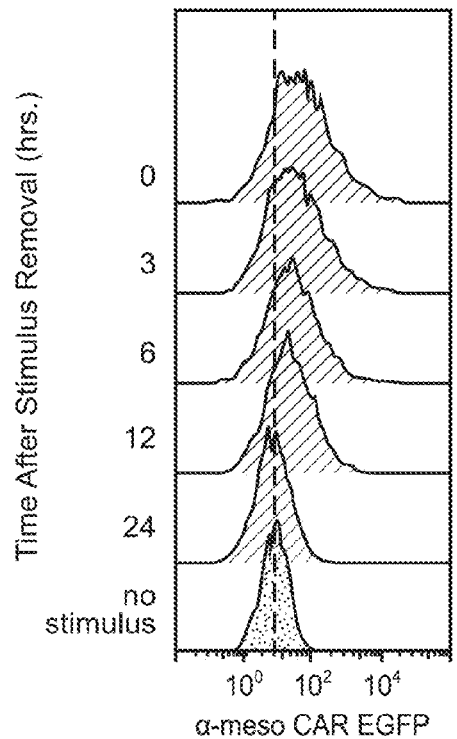
FIG. 66D
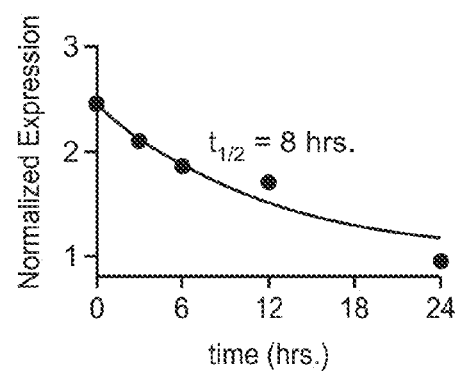
CAR Expression Returns to Basal Levels
by 24 hours after synNotch Antigen Removal

*In vitro* Stimulation of synNotch AND Gate T cells Shows Selective Luciferase Expression Upon Exposure to Surface GFP Expression Level of CD19 and GFP on
K562 Cancer Cell Lines Used for Xenografts Individual Mouse Data from Control T
cell Treated Two Tumor Mouse Model presence of GFP+ (single antigen) tumor does NOT prime T cells to kill CD19+ (single antigen) tumor

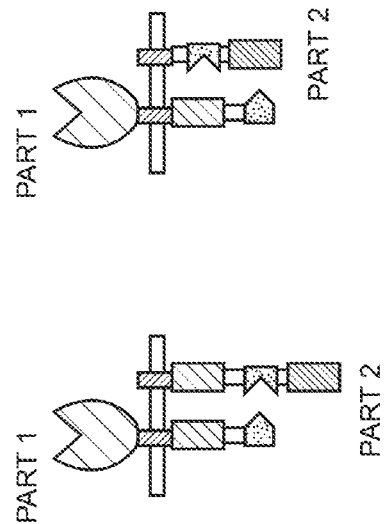
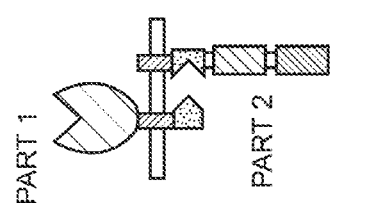
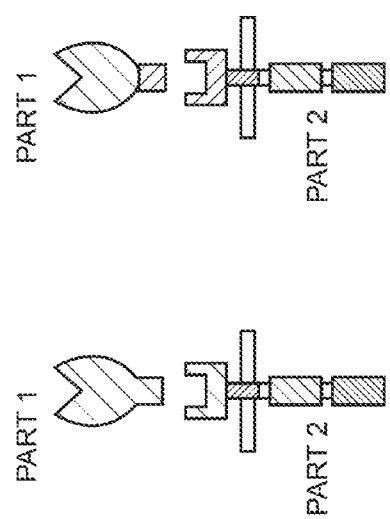
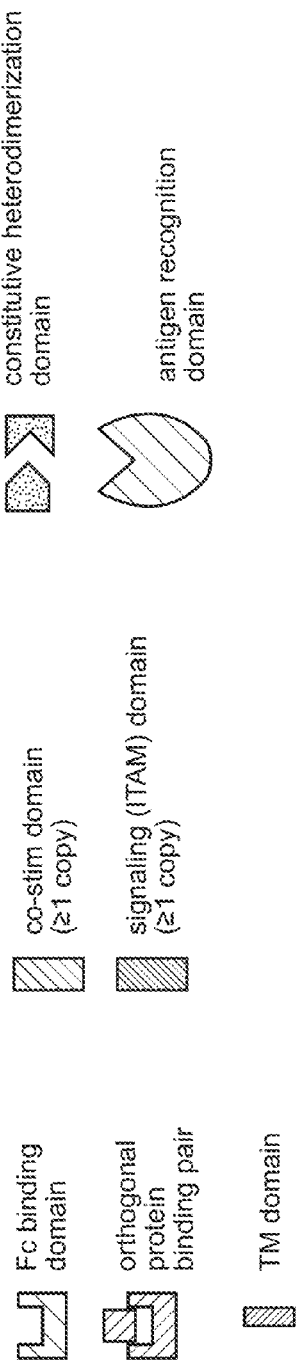

3 ANTIGEN INPUT AND GATE T CELL

3 ANTIGEN GATING

4 ANTIGEN INPUT AND GATE T CELL

5 ANTIGEN INPUT AND GATE T CELL 3 input gate (AND + NOT)
if antigens A and X but not B 4 antigen gating - A and B and X not C α-myc AF647

α-myc AF647

α-myc AF647

α-myc AF647

α-myc AF647

BINDING-TRIGGERED TRANSCRIPTIONAL SWITCHES AND METHODS OF USE THEREOF

CROSS-REFERENCE

This application claims the benefit of U.S. Provisional Patent Application No. 62/120,256, filed Feb. 24, 2015; U.S. Provisional Patent Application No. 62/257,153, filed Nov. 18, 2015; and U.S. Provisional Patent Application No. 62/269,758, filed Dec. 18, 2015, which applications are incorporated herein by reference in their entirety.

STATEMENT REGARDING FEDERALLY SPONSORED RESEARCH

This invention was made with government support under Grant Nos. EY016546; P50 GM081879; and R01 GM055040 awarded by the National Institutes of Health. The government has certain rights in the invention.

INCORPORATION BY REFERENCE OF SEQUENCE LISTING PROVIDED AS A TEXT FILE

A Sequence Listing is provided herewith as a text file, "UCSF-511WO_SeqList_ST25.txt" created on Jan. 26, 2016 and having a size of 649 KB. The contents of the text file are incorporated by reference herein in their entirety.

INTRODUCTION

Notch receptors are transmembrane proteins that mediate cell-cell contact signaling and play a central role in development and other aspects of cell-to-cell communication, e.g. communication between two contacting cells, in which one contacting cell is a "receiver" cell and the other contacting cell is a "sender" cell. Notch receptors expressed in a receiver cell recognize their ligands (the delta family of proteins), expressed on a sending cell. The engagement of notch and delta on these contacting cells leads to two-step proteolysis of the notch receptor that ultimately causes the release of the intracellular portion of the receptor from the membrane into the cytoplasm. This released domain alters receiver cell behavior by functioning as a transcriptional regulator. Notch receptors are involved in and are required for a variety of cellular functions during development and are critical for the function of a vast number of cell-types across species.

SUMMARY

The present disclosure provides binding-triggered transcriptional switch polypeptides, nucleic acids comprising nucleotide sequences encoding the binding-triggered transcriptional switch polypeptides, and host cells genetically modified with the nucleic acids. The present disclosure provides transgenic organisms comprising a nucleic acid encoding a binding-triggered transcriptional switch polypeptide of the present disclosure. Also provided are methods of locally modulating an activity of a cell using one or more binding-triggered transcriptional switch polypeptides and a localized cell activation system using one or more binding-triggered transcriptional switch polypeptides. A binding-triggered transcriptional switch polypeptide of the present disclosure is useful in a variety of applications, which are also provided.

The present disclosure provides chimeric Notch receptor polypeptides, nucleic acids comprising nucleotide sequences encoding the chimeric Notch receptor polypeptides, and host cells genetically modified with the nucleic acids. The present disclosure provides transgenic organisms comprising a nucleic acid encoding a chimeric Notch receptor polypeptide of the present disclosure. A chimeric Notch receptor polypeptide of the present disclosure is useful in a variety of applications, which are also provided.

The present disclosure provides a chimeric polypeptide (also referred to herein as a "chimeric Notch receptor polypeptide") comprising, from N-terminal to C-terminal and in covalent linkage: a) an extracellular domain comprising a first member of a specific binding pair; b) a Notch receptor polypeptide, wherein the Notch receptor polypeptide has a length of from 50 amino acids to 1000 amino acids, and comprises one or more ligand-inducible proteolytic cleavage sites; and c) an intracellular domain, wherein the first member of the specific binding pair is heterologous to the Notch receptor polypeptide, and wherein binding of the first member of the specific binding pair to a second member of the specific binding pair induces cleavage of the Notch receptor polypeptide at the one or more ligand-inducible proteolytic cleavage sites, thereby releasing the intracellular domain. In some cases, the Notch receptor polypeptide has a length of from 300 amino acids to 400 amino acids. In some cases, the chimeric Notch receptor polypeptide comprises a linker interposed between the extracellular domain and the Notch receptor polypeptide. In some cases, the intracellular domain is a transcriptional activator. In some cases, the intracellular domain is a transcriptional repressor. In some cases, the intracellular domain is a site-specific nuclease. In some cases, the site-specific nuclease is a Cas9 polypeptide. In some cases, the intracellular domain is a recombinase. In some cases, the intracellular domain is an inhibitory immunoreceptor. In some cases, the intracellular domain is an activating immunoreceptor. In some cases, the first member of the specific binding pair comprises an antibody-based recognition scaffold. In some cases, the first member of the specific binding pair comprises an antibody. In some cases, where the first member of the specific binding pair is an antibody, the antibody specifically binds a tumor-specific antigen, a disease-associated antigen, or an extracellular matrix component. In some cases, where the first member of the specific binding pair is an antibody, the antibody specifically binds a cell surface antigen, a soluble antigen, or an antigen immobilized on an insoluble substrate. In some cases, where the first member of the specific binding pair is an antibody, the antibody is a single-chain Fv. In some cases, the first member of the specific binding pair is a nanobody, a single-domain antibody, a diabody, a triabody, or a minibody. In some cases, the first member of the specific binding pair is a non-antibody-based recognition scaffold. In some cases, where the first member of the specific binding pair is a non-antibody-based recognition scaffold, the non-antibody-based recognition scaffold is an avimer, a DARPin, an adnectin, an avimer, an affibody, an anticalin, or an affilin. In some cases, the first member of the specific binding pair is an antigen. In some cases, where the first member of the specific binding pair is an antigen, the antigen is an endogenous antigen. In some cases, where the first member of the specific binding pair is an antigen, the antigen is an exogenous antigen. In some cases, the first member of the specific binding pair is a ligand for a receptor. In some cases, the first member of the specific binding pair is a receptor. In some cases, the first member of the specific binding pair is a cellular adhesion molecule (e.g., all or a portion of an extracellular region of a cellular adhesion molecule). In some cases, the first member of the specific binding pair comprises a first dimerization domain and wherein the second member of the specific binding pair comprises a second dimerization domain; for example, in some cases, binding of the first dimerization domain to the second dimerization domain is induced by a small molecule dimerization agent, and in other cases, binding of the first dimerization domain to the second dimerization domain is induced by light. In some cases, the Notch receptor polypeptide comprises an amino acid sequence having at least 75% amino acid sequence identity to any one of the amino acid sequences depicted in FIGS. 2A-2G. In some cases, the Notch receptor polypeptide comprises an amino acid sequence having at least 85% amino acid sequence identity to any one of the amino acid sequences depicted in FIGS. 2A-2G. In some cases, the Notch receptor polypeptide comprises an amino acid sequence having at least 90% amino acid sequence identity to any one of the amino acid sequences depicted in FIGS. 2A-2G. In some cases, the Notch receptor polypeptide comprises an amino acid sequence having at least 95% amino acid sequence identity to any one of the amino acid sequences depicted in FIGS. 2A-2G. In some cases, the Notch receptor polypeptide comprises an amino acid sequence having at least 98% amino acid sequence identity to any one of the amino acid sequences depicted in FIGS. 2A-2G. In some cases, the Notch receptor polypeptide comprises an amino acid sequence having at least 75% amino acid sequence identity to any one of the amino acid sequences depicted in FIG. 3. In some cases, the Notch receptor polypeptide comprises an amino acid sequence having at least 85% amino acid sequence identity to any one of the amino acid sequences depicted in FIG. 3. In some cases, the Notch receptor polypeptide comprises an amino acid sequence having at least 90% amino acid sequence identity to any one of the amino acid sequences depicted in FIG. 3. In some cases, the Notch receptor polypeptide comprises an amino acid sequence having at least 95% amino acid sequence identity to any one of the amino acid sequences depicted in FIG. 3. In some cases, the Notch receptor polypeptide comprises an amino acid sequence having at least 98% amino acid sequence identity to any one of the amino acid sequences depicted in FIG. 3. In some cases, the Notch receptor polypeptide comprises an amino acid sequence having at least 75%, at least 80%, at least 85%, at least 90%, at least 95%, at least 98%, or 100% amino acid sequence identity to the following sequence: PPQIEEACELPECQVDAGNKVCNLQCNNHACGWDGGDCSLNFNDPWKNCTQSLQCWK YFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQ QMIFPYYGHEEELRKHPIKRSTVGWATSSLLPGTSGGRQRRELDPMDIRGSIVYLEIDNR QCVQSSSQCFQSATDVAAFLGALASLGSLNIPYKIEAVKSEPVEPPLPSQLHLMYVAAAA FVLLFFVGCGVLLS (SEQ ID NO:1). In some cases, the Notch receptor polypeptide comprises an amino acid sequence having at least 75%, at least 80%, at least 85%, at least 90%, at least 95%, at least 98%, or 100% amino acid sequence identity to the following sequence: PCVGSNPCYNQGTCEPTSENPFYRCLCPAKFNGLLCHILDYSFTGGAGRDIPPPQIEEACE LPECQVDAGNKVCNLQCNNHACGWDGGDCSLNFNDPWKNCTQSLQC WKYFSDGHCD SQCNSAGCLFDGFDCQLTEGQCN- PLYDQYCKDHFSDGHCDQGCNSAECEWDGLDCAE HVPERLAAGTLVLVVLLPPDQLRNNSFHFLRELSHVLHTNVVFKRDAQGQQMIFPYYG HEEELRKHPIKRSTVGWATSSLLPGTSGGRQRRELDPMDIRGSIVYLEIDNRQCVQSSSQ CFQSATDVAAFLGALASLGSLNIPYKIEAVKSEPVEPPLPSQLHLMYVAAAAFVLLFFVG CGVLLS (SEQ ID NO:2). In some cases, the one or more ligand-inducible proteolytic cleavage sites are selected from S1, S2, and S3 proteolytic cleavage sites. In some cases, the S1 proteolytic cleavage site is a furin-like protease cleavage site comprising the amino acid sequence Arg-X-(Arg/Lys)-Arg, where X is any amino acid. In some cases, the S2 proteolytic cleavage site ADAM-17-type protease cleavage site comprising an Ala-Val dipeptide sequence. In some cases, the S3 proteolytic cleavage site is a γ-secretase cleavage site comprising a Gly-Val dipeptide sequence.

The present disclosure provides a nucleic acid comprising a nucleotide sequence encoding a chimeric Notch receptor polypeptide as described herein. The present disclosure provides a recombinant expression vector comprising a nucleotide sequence encoding a chimeric Notch receptor polypeptide as described herein. The present disclosure provides a host cell genetically modified with the nucleic acid, or the expression vector. In some cases, the host cell is a eukaryotic cell. In some cases, the host cell is a mammalian cell. In some cases, the host cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the host cell is genetically modified with a nucleic acid comprising a nucleotide sequence encoding a chimeric antigen receptor (CAR), and wherein the intracellular domain of the chimeric polypeptide is a transcriptional activator. In some cases, the nucleotide sequence encoding the CAR is operably linked to a transcriptional control element that is activated by the intracellular domain of the chimeric polypeptide.

The present disclosure provides a method of modulating an activity of a cell that expresses a chimeric Notch receptor polypeptide of the present disclosure as described herein, the method comprising: contacting the cell with a second member of the specific binding pair, wherein binding of the first member of the specific binding pair to the second member of the specific binding pair induces cleavage of the Notch receptor polypeptide at the one or more ligand-inducible proteolytic cleavage sites, thereby releasing the intracellular domain, wherein release of the intracellular domain modulates the activity of the cell. In some cases, said contacting is carried out in vivo, ex vivo, or in vitro. In some cases, the second member of the specific binding pair is on the surface of a second cell, is immobilized on an insoluble substrate, is present in an extracellular matrix, is present in an artificial matrix, or is soluble. In some cases, release of the intracellular domain modulates proliferation of the cell. In some cases, release of the intracellular domain modulates apoptosis in the cell. In some cases, release of the intracellular domain induces cell death by a mechanism other than apoptosis. In some cases, release of the intracellular domain modulates gene expression in the cell through transcriptional regulation, chromatin regulation, translation, trafficking or post-translational processing. In some cases, release of the intracellular domain modulates differentiation of the cell. In some cases, release of the intracellular domain modulates migration of the cell. In some cases, release of the intracellular domain modulates the expression and secretion of a molecule from the cell. In some cases, release of the intracellular domain modulates adhesion of the cell to a second cell or to an extracellular matrix. In some cases, release of the intracellular domain induces de novo expression a gene product in the cell. In some cases, where release of the intracellular domain induces de novo expression a gene product in the cell, the gene product is a transcriptional activator, a transcriptional repressor, a chimeric antigen receptor, a second chimeric Notch receptor polypeptide, a translation regulator, a cytokine, a hormone, a chemokine, or an antibody.

The present disclosure provides a method of modulating an activity of a cell that expresses a chimeric Notch receptor polypeptide of the present disclosure as described herein, the method comprising: contacting the cell with a second member of the specific binding pair, where binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a transcription factor that induces transcription of a nucleic acid encoding an effector polypeptide that modulates the activity of the cell. In some cases, said contacting is carried out in vivo, ex vivo, or in vitro. In some cases, the second member of the specific binding pair is on the surface of a second cell, is immobilized on an insoluble substrate, is present in an extracellular matrix, is present in an artificial matrix, or is soluble. In some cases, the effector polypeptide is an apoptosis inducer, apoptosis in inhibitor, an activating immunoreceptor, an inhibiting immunoreceptor, a transcription activator, a transcription repressor, a cytokine, a growth factor, a hormone, a receptor, an antibody, or a site-specific nuclease.

The present disclosure provides a method of modulating an activity of a cell, the method comprising: contacting the cell with a second member of a first specific binding pair, wherein the cell expresses: i) a first chimeric Notch receptor polypeptide of the present disclosure as described herein, comprising a first member of a first specific binding pair; and ii) at least a second chimeric Notch receptor polypeptide of the present disclosure as described herein, comprising a first member of a second specific binding pair, wherein the first and the second specific binding pairs are different from one another, wherein the intracellular domain of the first chimeric Notch receptor polypeptide provides a first effector function; and the intracellular domain of the second chimeric Notch receptor polypeptide provides a second effector function that is different from the first effector function, and wherein the released first and the second intracellular domains modulate activity of the cell. In some cases, said contacting is carried out in vivo. In some cases, said contacting is carried out ex vivo. In some cases, said contacting is carried out in vitro.

The present disclosure provides a method of activating a T cell, the method comprising: contacting a T cell as described herein (where the T cell is genetically modified with one or more nucleic acids comprising nucleotide sequences encoding: i) a chimeric Notch receptor polypeptide of the present disclosure; and ii) a CAR); with an immobilized antigen, wherein the extracellular domain of the chimeric Notch receptor polypeptide comprises an antibody specific for a first antigen, and wherein said contacting results in release of the transcriptional activator, and production of the CAR in the cell, wherein the CAR provides for activation of the T cell following binding of a second antigen.

The present disclosure provides a method of modulating an activity of a cell, the method comprising: contacting the cell with a second member of a first specific binding pair, wherein the cell expresses: i) a first chimeric Notch receptor polypeptide of the present disclosure, comprising a first member of a first specific binding pair; and ii) at least a second chimeric Notch receptor polypeptide of the present disclosure, comprising a first member of a second specific binding pair, wherein the first and the second specific binding pairs are different from one another, wherein the nucleotide sequence encoding the second chimeric Notch receptor is operably linked to a transcriptional control element that is activated or repressed by the intracellular domain of the first chimeric Notch receptor polypeptide. In some cases, said contacting is carried out in vivo. In some cases, said contacting is carried out ex vivo. In some cases, said contacting is carried out in vitro.

The present disclosure provides a method of activating a T cell, the method comprising: contacting a T cell as described herein (where the T cell is genetically modified with one or more nucleic acids comprising nucleotide sequences encoding: i) a chimeric Notch receptor polypeptide of the present disclosure; and ii) a CAR, where the intracellular domain of the chimeric Notch receptor polypeptide is a transcriptional activator) with an immobilized antigen, wherein the extracellular domain of the chimeric polypeptide comprises an antibody specific for a first antigen, and wherein said contacting results in release of the transcriptional activator, and production of the CAR in the cell, wherein the CAR provides for activation of the T cell following binding of a second antigen.

The present disclosure provides a method of modulating an activity of a cell, the method comprising: contacting the cell with an antigen that is immobilized on a surface, wherein the cell expresses a chimeric Notch receptor polypeptide of the present disclosure, wherein the first member of the specific binding pair binds the antigen, and wherein said contacting results in release of the intracellular domain and modulation of the activity of the cell. In some cases, the intracellular domain is a transcription factor that modulates differentiation of the cell.

The present disclosure provides method of locally modulating an activity of a cell, the method comprising: expressing in the cell a binding-triggered transcriptional switch comprising an extracellular domain comprising a first member of a specific binding pair, a binding-transducer and an intracellular domain; and contacting the cell with a second member of the specific binding pair, wherein binding of the first member of the specific binding pair to the second member of the specific binding pair induces the binding-transducer to transduce a binding signal to activate the intracellular domain, thereby producing an activated intracellular domain, wherein the activated intracellular domain modulates an activity of the cell selected from the group consisting of: expression of a gene product of the cell, proliferation of the cell, apoptosis of the cell, non-apoptotic death of the cell, differentiation of the cell, dedifferentiation of the cell, migration of the cell, secretion of a molecule from the cell and cellular adhesion of the cell.

In some cases, the activated intracellular domain modulates expression of an endogenous gene product of the cell.

In some cases, the endogenous gene product of the cell is selected from the group consisting of: a chemokine, a chemokine receptor, a cytokine, a cytokine receptor, a differentiation factor, a growth factor, a growth factor receptor, a hormone, a metabolic enzyme, a proliferation inducer, a receptor, a small molecule $2^{nd}$ messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis inhibitor, an apoptosis inducer, an immunoactivator, an immunoinhibitor and an inhibiting immunoreceptor.

In some cases, the endogenous gene product of the cell is a secreted gene product. In some cases, the endogenous gene product of the cell is a surface expressed gene product. In some cases, the activated intracellular domain simultaneously modulates expression of two or more endogenous gene products of the cell. In some cases, the activated intracellular domain modulates expression of a heterologous gene product of the cell.

In some cases, the heterologous gene product of the cell is selected from the group consisting of: a chemokine, a chemokine receptor, a chimeric antigen receptor, a cytokine, a cytokine receptor, a differentiation factor, a growth factor, a growth factor receptor, a hormone, a metabolic enzyme, a pathogen derived protein, a proliferation inducer, a receptor, a RNA guided nuclease, a site-specific nuclease, a small molecule 2nd messenger synthesis enzyme, a T cell receptor, a toxin derived protein, a transcription activator, a transcription repressor, a transcriptional activator, a transcriptional repressor, a translation regulator, a translational activator, a translational repressor, an activating immunoreceptor, an antibody, an apoptosis in inhibitor, an apoptosis inducer, an engineered T cell receptor, an immunoactivator, an immunoinhibitor, an inhibiting immunoreceptor, an RNA guided DNA binding protein and a second binding-triggered transcriptional switch.

In some instances, the heterologous gene product of the cell is an antibody selected from the group consisting of: 806, 9E10, 3F8, 81C6, 8H9, Abagovomab, Abatacept, Abciximab, Abituzumab, Abrilumab, Actoxumab, Adalimumab, Adecatumumab, Aducanumab, Afelimomab, Afutuzumab, Alacizumab pegol, ALD518, Alefacept, Alemtuzumab, Alirocumab, Altumomab pentetate, Amatuximab, AMG 102, Anatumomab mafenatox, Anetumab ravtansine, Anifrolumab, Anrukinzumab, Apolizumab, Arcitumomab, Ascrinvacumab, Aselizumab, Atacicept, Atezolizumab, Atinumab, Atlizumab/tocilizumab, Atorolimumab, AVE1642, Bapineuzumab, Basiliximab, Bavituximab, Bectumomab, Begelomab, Belimumab, Benralizumab, Bertilimumab, Besilesomab, Bevacizumab, Bezlotoxumab, Biciromab, Bimagrumab, Bimekizumab, Bivatuzumab mertansine, Blinatumomab, Blosozumab, BMS-936559, Bococizumab, Brentuximab vedotin, Briakinumab, Brodalumab, Brolucizumab, Brontictuzumab, Canakinumab, Cantuzumab mertansine, Cantuzumab ravtansine, Caplacizumab, Capromab pendetide, Carlumab, Catumaxomab, cBR96-doxorubicin immunoconjugate, CC49, CDP791, Cedelizumab, Certolizumab pegol, Cetuximab, cG250, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CP 751871, CR6261, Crenezumab, CS-1008, Dacetuzumab, Daclizumab, Dalotuzumab, Dapirolizumab pegol, Daratumumab, Dectrekumab, Demcizumab, Denintuzumab mafodotin, Denosumab, Derlotuximab biotin, Detumomab, Dinutuximab, Diridavumab, Dorlimomab aritox, Drozitumab, Duligotumab, Dupilumab, Durvalumab, Dusigitumab, Ecromeximab, Eculizumab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Epratuzumab, Erlizumab, Ertumaxomab, Etanercept, Etaracizumab, Etrolizumab, Evinacumab, Evolocumab, Exbivirumab, F19, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gemtuzumab ozogamicin, Gevokizumab, Girentuximab, Glembatumumab vedotin, Golimumab, Gomiliximab, Guselkumab, HGS-ETR2, hu3S193, huA33, Ibalizumab, Ibritumomab tiuxetan, Icrucumab, Idarucizumab, IGN101, IgN311, Igovomab, IIIA4, IM-2C6, IMAB362, Imalumab, IMC-A12, Imciromab, Imgatuzumab, Inclacumab, Indatuximab ravtansine, Indusatumab vedotin, Infliximab, Inolimomab, Inotuzumab ozogamicin, Intetumumab, Ipilimumab, Iratumumab, Isatuximab, Itolizumab, Ixekizumab, J591, KB004, Keliximab, KW-2871, Labetuzumab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Mapatumumab, Margetuximab, Maslimomab, Matuzumab, Mavrilimumab, MEDI4736, Mepolizumab, Metelimumab, METMAB, Milatuzumab, Minretumomab, Mirvetuximab soravtansine, Mitumomab, MK-0646, MK-3475, MM-121, Mogamulizumab, MORAb-003, Morolimumab, Motavizumab, MOv18, Moxetumomab pasudotox, MPDL33280A, Muromonab-CD3, Nacolomab tafenatox, Namilumab, Naptumomab estafenatox, Narnatumab, Natalizumab, Nebacumab, Necitumumab, Nemolizumab, Nerelimomab, Nesvacumab, Nimotuzumab, Nivolumab, Nofetumomab merpentan, Obiltoxaximab, Obinutuzumab, Ocaratuzumab, Ocrelizumab, Odulimomab, Ofatumumab, Olaratumab, Olokizumab, Omalizumab, Onartuzumab, Ontuxizumab, Opicinumab, Oportuzumab monatox, Oregovomab, Orticumab, Otelixizumab, Otlertuzumab, Oxelumab, Ozanezumab, Ozoralizumab, Pagibaximab, Palivizumab, Panitumumab, Pankomab, Panobacumab, Parsatuzumab, Pascolizumab, Pasotuxizumab, Pateclizumab, Patritumab, Pembrolizumab, Pemtumomab, Perakizumab, Pertuzumab, Pexelizumab, Pidilizumab, Pinatuzumab vedotin, Pintumomab, Placulumab, Polatuzumab vedotin, Ponezumab, Priliximab, Pritoxaximab, Pritumumab, PRO 140, Quilizumab, R1507, Racotumomab, Radretumab, Rafivirumab, Ralpancizumab, Ramucirumab, Ranibizumab, Raxibacumab, Refanezumab, Regavirumab, Reslizumab, Rilotumumab, Rinucumab, Rituximab, Robatumumab, Roledumab, Romosozumab, Rontalizumab, Rovelizumab, Rupliximab, Sacituzumab govitecan, Samalizumab, Sarilumab, Satumomab pendetide, SCH 900105, Secukinumab, Seribantumab, Setoxaximab, Sevirumab, SGN-CD19A, SGN-CD33A, Sibrotuzumab, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teplizumab, Teprotumumab, Tesidolumab, Tetulomab, TGN1412, Ticilimumab/tremelimumab, Tigatuzumab, Tildrakizumab, TNX-650, Tocilizumab, Toralizumab, Tosatoxumab, Tositumomab, Tovetumab, Tralokinumab, Trastuzumab, TRBS07, Tregalizumab, Tremelimumab, Trevogrumab, Tucotuzumab celmoleukin, Tuvirumab, Ublituximab, Ulocuplumab, Urelumab, Urtoxazumab, Ustekinumab, Vandortuzumab vedotin, Vantictumab, Vanucizumab, Vapaliximab, Varlilumab, Vatelizumab, Vedolizumab, Veltuzumab, Vepalimomab, Vesencumab, Visilizumab, Volociximab, Vorsetuzumab mafodotin, Votumumab, Zalutumumab, Zanolimumab, Zatuximab, Ziralimumab and Zolimomab aritox.

In some cases, the heterologous gene product of the cell is a secreted gene product. In some cases, the heterologous gene product of the cell is a surface expressed gene product. In some cases, the activated intracellular domain simultaneously modulates expression of two or more heterologous gene products of the cell. In some cases, the contacting is carried out in vivo, ex vivo, or in vitro.

In some cases, the second member of the specific binding pair is on the surface of a second cell, is immobilized on an insoluble substrate, is present in an extracellular matrix, is present in an artificial matrix, or is soluble. In some cases, the intracellular the transcription factor directly modulates differentiation of the cell. In some cases, the transcription factor indirectly modulates differentiation of the cell by modulating the expression of a second transcription factor.

In some cases, the cell is an immune cell and the activity of the cell is differentiation of the immune cell. In some cases, the cell is an immune cell, the intracellular domain is a transcription factor that modulates differentiation of the cell and the activity of the cell is differentiation of the immune cell. In some cases, the transcription factor directly modulates differentiation of the immune cell. In some cases, the transcription factor indirectly modulates differentiation of the immune cell by modulating the expression of a second transcription factor.

In some cases, the cell is a stem cell and the activity of the cell is differentiation of the stem cell. In some cases, the cell is a progenitor or precursor cell and the activity of the cell is differentiation of the progenitor or precursor cell.

In some cases, activation of the intracellular domain modulates expression of an endogenous gene of the cell through transcriptional regulation, chromatin regulation, translation, trafficking or post-translational processing. In some cases, activation of the intracellular domain modulates cellular adhesion of the cell to a second cell or to an extracellular matrix.

In some cases, the binding-transducer comprises a ligand-inducible proteolytic cleavage site, wherein binding of the first member of the specific binding pair to the second member of the specific binding pair induces cleavage of the binding-transducer at the ligand-inducible proteolytic cleave site, thereby transducing the binding signal and activating the intracellular domain by proteolytically releasing the intracellular domain.

The present disclosure provides a method of modulating an activity of a cell, the method comprising: contacting the cell with a second member of a first specific binding pair and a second member of a second specific binding pair, wherein the cell expresses: i) a first binding-triggered transcriptional switch comprising an extracellular domain comprising a first member of the first specific binding pair, a binding-transducer and an intracellular domain; and ii) at least a second binding-triggered transcriptional switch comprising an extracellular domain comprising the first member of a second specific binding pair, a binding-transducer and an intracellular domain; wherein the intracellular domain of the first binding-triggered transcriptional switch provides a first effector function and the intracellular domain of the second binding-triggered transcriptional switch provides a second effector function that is different from the first effector function when binding of the first and second members of the first and second specific binding pairs induces the binding-transducers to transduce binding signals to activate the first and second intracellular domains.

In some cases, the effector function of the intracellular domain of the first binding-triggered transcriptional switch modulates expression of a gene product of the cell.

In some cases, the gene product of the cell is an endogenous gene product of the cell. In some cases, the gene product of the cell is a heterologous gene product of the cell. In some cases, the gene product of the cell is a gene product of the cell is selected from the group consisting of: a chemokine, a chemokine receptor, a cytokine, a cytokine receptor, a differentiation factor, a growth factor, a growth factor receptor, a hormone, a metabolic enzyme, a proliferation inducer, a receptor, a small molecule $2^{nd}$ messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis in inhibitor, an apoptosis inducer, an immunoactivator, an immunoinhibitor and an inhibiting immunoreceptor.

In some cases, the effector function of the intracellular domain of the second binding-triggered transcriptional switch modulates expression of a gene product of the cell. In some cases, the gene product of the cell is an endogenous gene product of the cell. In some cases, the gene product of the cell is a heterologous gene product of the cell.

In some cases, the gene product of the cell is selected from the group consisting of: a chemokine, a chemokine receptor, a cytokine, a cytokine receptor, a differentiation factor, a growth factor, a growth factor receptor, a hormone, a metabolic enzyme, a proliferation inducer, a receptor, a small molecule $2^{nd}$ messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis in inhibitor, an apoptosis inducer, an immunoactivator, an immunoinhibitor and an inhibiting immunoreceptor.

In some cases, at least one of the binding-transducers of the first and second binding-triggered transcriptional switches comprises a ligand-inducible proteolytic cleavage site, wherein binding of the first and second members of the respective specific binding pair induces cleavage of the binding-transducer at the ligand-inducible proteolytic cleave site, thereby transducing the binding signal and activating the respective intracellular domain by proteolytically releasing the intracellular domain.

In some cases, the binding-transducers of the first and second binding-triggered transcriptional switches both comprise a ligand-inducible proteolytic cleavage site.

In some instances, the method further includes contacting the cell with a soluble inhibitor molecule that competitively inhibits the binding of the first member of the specific binding pair to the second member of the specific binding pair, thereby preventing induction of the binding-transducer to transduce a binding signal to activate the intracellular domain, wherein contacting the cell with the soluble inhibitor molecule comprises applying or administering the soluble inhibitor molecule to first cell and/or placing the cell in the presence of a second cell that expresses the soluble inhibitor molecule. In some instances, the second cell constitutively expresses the soluble inhibitor molecule. In some instances, the second cell conditionally expresses the soluble inhibitor molecule.

The present disclosure provides a method of modulating an activity of a cell, the method comprising: contacting the cell with a second member of a first specific binding pair, wherein the cell expresses: i) a first binding-triggered transcriptional switch comprising an extracellular domain comprising a first member of the first specific binding pair, a binding-transducer and an intracellular domain; and ii) at least a second binding-triggered transcriptional switch comprising an extracellular domain comprising the first member of a second specific binding pair, a binding-transducer and an intracellular domain, wherein the nucleotide sequence encoding the second binding-triggered transcriptional switch is operably linked to a transcriptional control element that is activated or repressed by the intracellular domain of the first binding-triggered transcriptional switch.

In some cases, the contacting is carried out in vivo, ex vivo, or in vitro. In some cases, the second member of the first specific binding pair is on the surface of a second cell, is immobilized on an insoluble substrate, is present in an extracellular matrix, is present in an artificial matrix, or is soluble.

In some cases, activation of the intracellular domain of the second binding-triggered transcriptional switch modulates an activity of the cell selected from the group consisting of: expression of a gene product of the cell, proliferation of the cell, apoptosis of the cell, non-apoptotic death of the cell, differentiation of the cell, dedifferentiation of the cell, migration of the cell, secretion of a molecule from the cell and cellular adhesion of the cell.

In some cases, the activity of the cell is expression of a gene product of the cell. In some cases, the gene product of the cell is a gene product of the cell is selected from the group consisting of: a chemokine, a chemokine receptor, a cytokine, a cytokine receptor, a differentiation factor, a growth factor, a growth factor receptor, a hormone, a metabolic enzyme, a proliferation inducer, a receptor, a small molecule $2^{nd}$ messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis in inhibitor, an apoptosis inducer, an immunoactivator, an immunoinhibitor and an inhibiting immunoreceptor.

In some cases, at least one of the binding-transducers of the first and second binding-triggered transcriptional switches comprises a ligand-inducible proteolytic cleavage site, wherein binding of the first and second members of the respective specific binding pair induces cleavage of the binding-transducer at the ligand-inducible proteolytic cleave site, thereby transducing the binding signal and activating the respective intracellular domain by proteolytically releasing the intracellular domain.

The present disclosure provides a method of tracking cell-cell contacts, the method comprising: expressing in each cell of a first plurality of cells an binding-triggered transcriptional switch comprising an extracellular domain comprising a first member of a specific binding pair, a binding-transducer and an intracellular domain; expressing in each cell of a second plurality of cells a second member of the specific binding pair; and contacting the first plurality of cells with the second plurality of cells, wherein binding of the first member of the specific binding pair to the second member of the specific binding pair induces the binding-transducer to transduce a binding signal of the binding-triggered transcriptional switch, thereby activating the intracellular domain, wherein activation of the intracellular domain induces expression of a detectable reporter sufficient to track cell-cell contacts in space, in time or a combination thereof.

In some cases, the first plurality of cells, the second plurality of cells or both are neurons. In some cases, the binding-transducer comprises a ligand-inducible proteolytic cleavage site, wherein binding of the first member of the specific binding pair to the second member of the specific binding pair induces cleavage of the binding-transducer at the ligand-inducible proteolytic cleave site, thereby transducing the binding signal and activating the intracellular domain by proteolytically releasing the intracellular domain.

In some cases, the binding-triggered transcriptional switch, including those described above and herein is a SynNotch polypeptide.

The present disclosure also provides a localized cell activation system, the system comprising: a cell comprising: an expressed binding-triggered transcriptional switch comprising an extracellular domain comprising a first member of a first specific binding pair, a binding-transducer and an intracellular domain; and a nucleic acid, operably linked to a transcriptional control element that is induced by the intracellular domain of the first binding-triggered transcriptional switch, encoding a binding-triggered activating polypeptide comprising a first member of a second specific binding pair; wherein upon contact with the second member of the first specific binding pair the binding-triggered activating polypeptide is expressed and upon contact with the second member of the second specific binding pair the binding-triggered activating polypeptide activates the cell.

In some cases, the cell is selected from the group consisting of: an immune cell, a progenitor or precursor cell, a stem cell and a neuron. In some cases, the cell is an immune cell, the binding-triggered transcriptional switch is an antigen triggered transcriptional switch and the binding-triggered activating polypeptide is an antigen triggered activating polypeptide, wherein upon contact with the second member of the first specific binding pair the antigen triggered activating polypeptide is expressed and upon contact with the second member of the second specific binding pair the antigen triggered activating polypeptide activates the immune cell to recognize target cells expressing the first member of the second specific binding pair.

In some cases, the antigen triggered activating polypeptide is a chimeric antigen receptor or a variant thereof. In some cases, the antigen triggered activating polypeptide is an engineered T cell receptor or a variant thereof. In some cases, the expressed binding-triggered transcriptional switch is a SynNotch polypeptide.

The present disclosure provides a method of locally modulating an activity of a cell, the method comprising: expressing in a first cell a binding-triggered transcriptional switch comprising a binding-transducer, an intracellular domain and a first extracellular domain comprising a first adaptor binding domain that specifically binds a first epitope on a soluble adaptor molecule; contacting the first cell with: i) a second cell that expresses a second extracellular domain comprising a second adaptor binding domain that specifically binds a second epitope on the soluble adaptor molecule; and ii) an effective concentration of the soluble adaptor molecule, wherein binding of the first adaptor binding domain and the second adaptor binding domain to the adaptor molecule induces the binding-transducer to transduce a binding signal to activate the intracellular domain, thereby producing an activated intracellular domain, wherein the activated intracellular domain modulates an activity of the first cell that is selected from the group consisting of: expression of a gene product of the cell, proliferation of the cell, apoptosis of the cell, non-apoptotic death of the cell, differentiation of the cell, dedifferentiation of the cell, migration of the cell, secretion of a molecule from the cell and cellular adhesion of the cell. In some instances, the contacting comprises applying the soluble adaptor molecule to the cells in vitro or ex vivo or administering the soluble adaptor molecule to the cells in vivo. In some instances, contacting the first cell with an effective concentration of the soluble adaptor molecule comprises placing the first cell in the presence of a third cell that expresses the adaptor molecule, wherein the third cell constitutively or conditionally expresses the adaptor molecule. In some instances, the first extracellular domain and the soluble adaptor molecule are first and second members of a specific binding pair. In some instances, the second extracellular domain and the soluble adaptor molecule are first and second members of a specific binding pair. In some instances, the first extracellular domain and second extracellular domain are antibodies or nanobodies. In some instances, the intracellular domain is a transcription factor. In some instances, the activated intracellular domain modulates expression of an endogenous or heterologous gene product of the first cell. In some instances, the binding-transducer comprises a ligand-inducible proteolytic cleavage site, wherein binding of the first extracellular domain and the second extracellular domain to the soluble adaptor molecule induces cleavage of the binding-transducer at the ligand-inducible proteolytic cleave site, thereby transducing the binding signal and activating the intracellular domain by proteolytically releasing the intracellular domain.

The present disclosure provides a host cell comprising: a nucleic acid encoding a first binding-triggered transcriptional switch responsive to a first antigen; a first promoter that is responsive to the first binding-triggered transcriptional switch and is operably linked to a nucleic acid encoding a CAR comprising an extracellular domain that specifically binds to a first member of a specific binding pair; a nucleic acid encoding a second binding-triggered transcriptional switch responsive to a second antigen; and a second promoter that is responsive to the second binding-triggered transcriptional switch and operably linked to nucleic acid encoding an intracellular CAR inhibitory domain, wherein in the presence of the second antigen the intracellular CAR inhibitory domain is expressed inhibiting activation of the cell by the CAR and in the presence of the first antigen but not the second antigen the CAR is expressed and activatable by the second member of the specific binding pair.

The present disclosure provides a host cell comprising: a nucleic acid encoding a first binding-triggered transcriptional switch responsive to a first antigen; a first promoter that is responsive to the first binding-triggered transcriptional switch and is operably linked to a nucleic acid encoding a first portion of a CAR comprising an extracellular domain that specifically binds to a first member of a specific binding pair; a nucleic acid encoding a second binding-triggered transcriptional switch responsive to a second antigen; and a second promoter that is responsive to the second binding-triggered transcriptional switch and operably linked to nucleic acid encoding a second portion of a CAR comprising an intracellular signaling domain, wherein in the presence of the first antigen and second antigen the first and second portions of the CAR are expressed and the CAR is activatable by the second member of the specific binding pair. In some instances, the cell further comprises a nucleic acid encoding a third binding-triggered transcriptional switch responsive to a third antigen; and a third promoter that is responsive to the third binding-triggered transcriptional switch and is operably linked to a nucleic acid encoding an intracellular CAR inhibitory domain, wherein in the presence of the third antigen the intracellular CAR inhibitory domain is expressed inhibiting activation of the cell by the CAR.

BRIEF DESCRIPTION OF THE DRAWINGS

FIGS. 2A-2G provide amino acid sequences of Notch receptor polypeptides of various species (SEQ ID NOs:131-137).

FIG. 3 provides an amino acid sequence alignment of a portion of Notch receptor polypeptides of various mammalian species (mouse—SEQ ID NO:138; human—SEQ ID NO:139; cow—SEQ ID NO:140).

FIGS. 9A and 9B provide schematic depictions of use of multiple chimeric Notch receptor polypeptides in parallel.

FIGS. 16A-16C depict examples of Notch receptor polypeptides (SEQ ID NOs:141-143).

FIGS. 17-29 provide amino acid sequences of exemplary chimeric Notch receptor polypeptides (FIG. 17A-C—SEQ ID NOs:144-146; FIG. 18—SEQ ID NO:147; FIG. 19A-B—SEQ ID NOs:148-149; FIGS. 20A-20D—SEQ ID NOs: 150-153; FIG. 21—SEQ ID NO:154; FIG. 22—SEQ ID NO:155; FIG. 23—SEQ ID NO:156; FIG. 24—SEQ ID NO:157; FIG. 25—SEQ ID NO:158; FIG. 26—SEQ ID NO:159; FIG. 27—SEQ ID NO:160; FIG. 28—SEQ ID NO:161; FIG. 29—SEQ ID NO:162).

FIGS. 38A-38C demonstrate that SynNotch receptors can be used to program contact dependent transcriptional regulation.

FIGS. 39A-39D provides additional data related to FIGS. 37A and 37B.

FIGS. 40A-40C provides additional data related to FIGS. 38A-C.

FIGS. 41A-41B demonstrate that SynNotch receptors function in diverse cell types.

FIGS. 42A-42C provide additional data related to FIGS. 41A-41B.

FIGS. 43A-43D demonstrate that SynNotch receptors yield spatial control of diverse cellular behaviors.

FIGS. 44A-44C provide additional data related to FIGS. 43A-D.

FIGS. 45A-45C demonstrate that SynNotch receptors are orthogonal to one another and can be used for combinatorial regulation.

FIGS. 50A-50F demonstrate that synNotch receptors can drive antigen-induced custom cytokine programs.

FIGS. 51A-51E demonstrates that synNotch receptors can drive antigen-dependent skewing of T cell differentiation to the anti-tumor Th1 fate.

FIGS. 52A-52E demonstrate custom T cell delivery of non-native therapeutic—synNotch driven TRAIL production.

FIGS. 58A-58H provide supplemental data related to FIGS. 52A-52E.

FIGS. 59A-59E provide supplemental data related to FIGS. 53A-53C.

FIGS. 61A-61D demonstrate synNotch-Gated CAR expression—combinatorial antigen requirement for Jurkat T cell activation.

FIGS. 62A-62F demonstrate synNotch Gated CAR expression in human primary T cells—combinatorial antigen control over therapeutic T cell activation and tumor killing.

FIGS. 64A-64D show selective combinatorial antigen tumor killing in vivo by synNotch gated CAR expression.

FIGS. 65A-65C show that synNotch receptors control and localize CAR T cell response for precision immunotherapy.

FIGS. 66A-66D provide supplemental data related to FIGS. 61A-61D.

FIGS. 81A-81F provide schematic representations of particular embodiments of split CAR systems as described herein (FIG. 81F identifies the elements of the schematics represented in FIGS. 81A-81E).

DEFINITIONS

Figure 1:
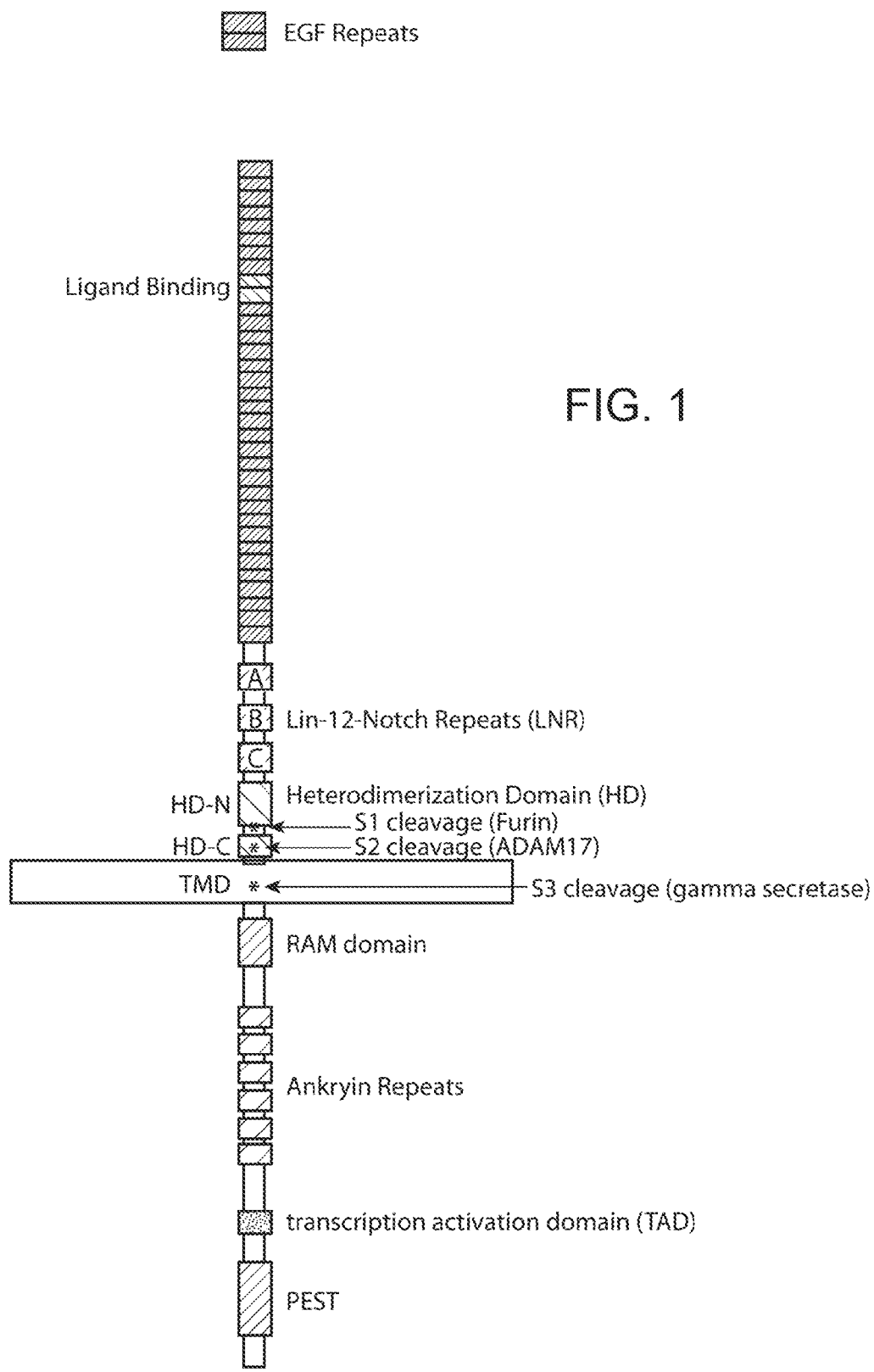
FIG. 1 is a schematic depiction of a Notch receptor polypeptide.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

"Operably linked" refers to a juxtaposition wherein the components so described are in a relationship permitting them to function in their intended manner. For instance, a promoter is operably linked to a coding sequence if the promoter affects its transcription or expression.

A "vector" or "expression vector" is a replicon, such as plasmid, phage, virus, or cosmid, to which another DNA segment, i.e. an "insert", may be attached so as to bring about the replication of the attached segment in a cell.

"Heterologous," as used herein, means a nucleotide or polypeptide sequence that is not found in the native (e.g., naturally-occurring) nucleic acid or protein, respectively.

The terms "antibodies" and "immunoglobulin" include antibodies or immunoglobulins of any isotype, fragments of antibodies that retain specific binding to antigen, including, but not limited to, Fab, Fv, scFv, and Fd fragments, chimeric antibodies, humanized antibodies, single-chain antibodies (scAb), single domain antibodies (dAb), single domain heavy chain antibodies, a single domain light chain antibodies, nanobodies, bi-specific antibodies, multi-specific antibodies, and fusion proteins comprising an antigen-binding (also referred to herein as antigen binding) portion of an antibody and a non-antibody protein. The antibodies can be detectably labeled, e.g., with a radioisotope, an enzyme that generates a detectable product, a fluorescent protein, and the like. The antibodies can be further conjugated to other moieties, such as members of specific binding pairs, e.g., biotin (member of biotin-avidin specific binding pair), and the like. The antibodies can also be bound to a solid support, including, but not limited to, polystyrene plates or beads, and the like. Also encompassed by the term are Fab', Fv, F(ab')$_2$, and or other antibody fragments that retain specific binding to antigen, and monoclonal antibodies. As used herein, a monoclonal antibody is an antibody produced by a group of identical cells, all of which were produced from a single cell by repetitive cellular replication. That is, the clone of cells only produces a single antibody species. While a monoclonal antibody can be produced using hybridoma production technology, other production methods known to those skilled in the art can also be used (e.g., antibodies derived from antibody phage display libraries). An antibody can be monovalent or bivalent. An antibody can be an Ig monomer, which is a "Y-shaped" molecule that consists of four polypeptide chains: two heavy chains and two light chains connected by disulfide bonds.

The term "humanized immunoglobulin" as used herein refers to an immunoglobulin comprising portions of immunoglobulins of different origin, wherein at least one portion comprises amino acid sequences of human origin. For example, the humanized antibody can comprise portions derived from an immunoglobulin of nonhuman origin with the requisite specificity, such as a mouse, and from immunoglobulin sequences of human origin (e.g., chimeric immunoglobulin), joined together chemically by conventional techniques (e.g., synthetic) or prepared as a contiguous polypeptide using genetic engineering techniques (e.g., DNA encoding the protein portions of the chimeric antibody can be expressed to produce a contiguous polypeptide chain). Another example of a humanized immunoglobulin is an immunoglobulin containing one or more immunoglobulin chains comprising a complementarity-determining region (CDR) derived from an antibody of nonhuman origin and a framework region derived from a light and/or heavy chain of human origin (e.g., CDR-grafted antibodies with or without framework changes). Chimeric or CDR-grafted single chain antibodies are also encompassed by the term humanized immunoglobulin. See, e.g., Cabilly et al., U.S. Pat. No. 4,816,567; Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Padlan, E. A. et al., European Patent Application No. 0,519,596 A1. See also, Ladner et al., U.S. Pat. No. 4,946,778; Huston, U.S. Pat. No. 5,476,786; and Bird, R. E. et al., Science, 242: 423-426 (1988)), regarding single chain antibodies.

The term "nanobody" (Nb), as used herein, refers to the smallest antigen binding fragment or single variable domain (V$_{HH}$) derived from naturally occurring heavy chain antibody and is known to the person skilled in the art. They are derived from heavy chain only antibodies, seen in camelids (Hamers-Casterman et al., 1993; Desmyter et al., 1996). In the family of "camelids" immunoglobulins devoid of light polypeptide chains are found. "Camelids" comprise old world camelids (*Camelus bactrianus* and *Camelus drom-*

*edarius*) and new world camelids (for example, *Llama paccos, Llama glama, Llama guanicoe* and *Llama vicugna*). A single variable domain heavy chain antibody is referred to herein as a nanobody or a $V_{HH}$ antibody.

"Antibody fragments" comprise a portion of an intact antibody, for example, the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 (1995)); domain antibodies (dAb; Holt et al. (2003) *Trends Biotechnol.* 21:484); single-chain antibody molecules; and multi-specific antibodies formed from antibody fragments. Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen combining sites and is still capable of cross-linking antigen.

"Fv" is the minimum antibody fragment that contains a complete antigen-recognition and -binding site. This region consists of a dimer of one heavy- and one light-chain variable domain in tight, non-covalent association. It is in this configuration that the three CDRS of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The "Fab" fragment also contains the constant domain of the light chain and the first constant domain (CH$_1$) of the heavy chain. Fab fragments differ from Fab' fragments by the addition of a few residues at the carboxyl terminus of the heavy chain CH$_1$ domain including one or more cysteines from the antibody hinge region. Fab'-SH is the designation herein for Fab' in which the cysteine residue(s) of the constant domains bear a free thiol group. F(ab)$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these classes can be further divided into subclasses (isotypes), e.g., IgG1, IgG2, IgG3, IgG4, IgA, and IgA2. The subclasses can be further divided into types, e.g., IgG2a and IgG2b.

"Single-chain Fv" or "sFv" or "scFv" antibody fragments comprise the $V_H$ and $V_L$ domains of antibody, wherein these domains are present in a single polypeptide chain. In some embodiments, the Fv polypeptide further comprises a polypeptide linker between the $V_H$ and $V_L$ domains, which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (1993) *Proc. Natl. Acad. Sci. USA* 90:6444-6448.

As used herein, the term "affinity" refers to the equilibrium constant for the reversible binding of two agents (e.g., an antibody and an antigen) and is expressed as a dissociation constant ($K_D$). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1,000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more. As used herein, the term "avidity" refers to the resistance of a complex of two or more agents to dissociation after dilution. The terms "immunoreactive" and "preferentially binds" are used interchangeably herein with respect to antibodies and/or antigen-binding fragments.

The term "binding" refers to a direct association between two molecules, due to, for example, covalent, electrostatic, hydrophobic, and ionic and/or hydrogen-bond interactions, including interactions such as salt bridges and water bridges. In some cases, the first member of a specific binding pair present in the extracellular domain of a chimeric Notch receptor polypeptide of the present disclosure binds specifically to a second member of the specific binding pair. "Specific binding" refers to binding with an affinity of at least about $10^{-7}$ M or greater, e.g., $5 \times 10^{-7}$ M, $10^{-8}$M, $5 \times 10^{-8}$M, and greater. "Non-specific binding" refers to binding with an affinity of less than about $10^{-7}$ M, e.g., binding with an affinity of $10^{-6}$ M, $10^{-5}$ M, $10^{-4}$ M, etc.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

An "isolated" polypeptide is one that has been identified and separated and/or recovered from a component of its natural environment. Contaminant components of its natural environment are materials that would interfere with diagnostic or therapeutic uses for the polypeptide, and may include enzymes, hormones, and other proteinaceous or nonproteinaceous solutes. In some embodiments, the polypeptide will be purified (1) to greater than 90%, greater than 95%, or greater than 98%, by weight of antibody as determined by the Lowry method, for example, more than 99% by weight, (2) to a degree sufficient to obtain at least 15 residues of N-terminal or internal amino acid sequence by use of a spinning cup sequenator, or (3) to homogeneity by sodium dodecyl sulfate-polyacrylamide gel electrophoresis (SDS-PAGE) under reducing or nonreducing conditions using Coomassie blue or silver stain. Isolated polypeptide includes the polypeptide in situ within recombinant cells since at least one component of the polypeptide's natural environment will not be present. In some instances, isolated polypeptide will be prepared by at least one purification step.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013); 5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al. Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety.

As used herein, GFP nanobodies may be referred to herein according to their "LaG" (Llama antibody against GFP) nomenclature according to Fridy et al. (2014) *Nat. Methods.* 11(12):1253-1260; the disclosure of which, including related supplemental materials, is incorporated herein by reference in its entirety. Accordingly, e.g., in instances where GFP (or mutant of GFP or other Cnidarian fluorescent proteins related to GFP (e.g., AmCFP, DsRed, etc.), is used as an adaptor molecule, various combinations of LaG nanobodies may find use provided the members of the LaG nanobody pair do not interfere with one another in their binding to GFP, e.g., where the members of the pair of LaG nanobodies bind different epitopes of GFP. LaG nanobodies include but are not limited to e.g., LaG-2, LaG-3, LaG-6, LaG-9, LaG-10, LaG-12, LaG-14, LaG-16, LaG-17, LaG-19, LaG-21, LaG-24, LaG-26, LaG-27, LaG-29, LaG-30, LaG-35, LaG-37, LaG-41, LaG-42, LaG-43, LaG-5, LaG-8, LaG-11, LaG-18, LaG16-$G_4$S-2, LaG16-3×FLAG-2, LaG41-$G_4$S-2, and the like. In some instances, llama antibodies against mCherry (LaM) may also find use in the systems and devices as described herein where, e.g., LaM nanobodies include but are not limited to e.g., LaM-1, LaM-2, LaM-3, LaM-4, LaM-6, LaM-8.

As used herein, the terms "treatment," "treating," "treat" and the like, refer to obtaining a desired pharmacologic and/or physiologic effect. The effect can be prophylactic in terms of completely or partially preventing a disease or symptom thereof and/or can be therapeutic in terms of a partial or complete cure for a disease and/or adverse effect attributable to the disease. "Treatment," as used herein, covers any treatment of a disease in a mammal, particularly in a human, and includes: (a) preventing the disease from occurring in a subject which can be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (rats, mice), non-human primates, humans, canines, felines, ungulates (e.g., equines, bovines, ovines, porcines, caprines), lagomorphs, etc. In some cases, the individual is a human. In some cases, the individual is a non-human primate. In some cases, the individual is a rodent, e.g., a rat or a mouse. In some cases, the individual is a lagomorph, e.g., a rabbit.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a chimeric Notch receptor polypeptide" includes a plurality of such chimeric Notch receptor polypeptide and reference to "the genetically modified host cell" includes reference to one or more genetically modified host cells and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides chimeric Notch receptor polypeptides, nucleic acids comprising nucleotide sequences encoding the chimeric Notch receptor polypeptides, and host cells genetically modified with the nucleic acids. A chimeric Notch receptor polypeptide is useful in a variety of applications, which are also provided.

The instant disclosure includes binding-triggered transcriptional switches and methods of using binding-triggered transcriptional switches. As used herein, a "binding-triggered transcriptional switch" generally refers to a synthetic modular polypeptide or system of interacting polypeptides having an extracellular domain that includes a first member of a specific binding pair, a binding-transducer and an intracellular domain. Upon binding of the second member of the specific binding pair to the binding-triggered transcriptional switch the binding signal is transduced to the intracellular domain such that the intracellular domain becomes activated and performs some function within the cell that it does not perform in the absence of the binding signal.

The components of binding-triggered transcriptional switches and the arrangement of the components of the switch relative to one another will vary depending on many factors including but not limited to e.g., the desired binding trigger, the activity of the intracellular domain, the overall function of the binding-triggered transcriptional switch, the broader arrangement of a molecular circuit comprising the binding-triggered transcriptional switch, etc. The first binding member may include but is not limited to e.g., those first and/or second binding members of specific binding pairs described herein. The intracellular domain may include but is not limited e.g., those intracellular domains and or domains having the biological functions as described herein.

The binding transducer of binding-triggered transcriptional switches will also vary depending on the desired method of transduction of the binding signal. Generally, binding transducers may include those polypeptides and/or domains of those polypeptides that transduce an extracellular signal to intracellular signaling e.g., as performed by the receptors of various signal transduction pathways. Transduction of a binding signal may be achieved through various mechanisms including but not limited to e.g., binding-induced proteolytic cleavage, binding-induced phosphorylation, binding-induced conformational change, etc. In some instances, a binding-transducer may contain a ligand-inducible proteolytic cleavage site such that upon binding the binding-signal is transduced by cleavage of the binding-triggered transcriptional switch, e.g., to liberate an intracellular domain. For example, in some instances, a binding-triggered transcriptional switch may include a Notch derived cleavable binding transducer, such as, e.g., a chimeric notch receptor polypeptide as described herein.

In other instances, the binding signal may be transduced in the absence of inducible proteolytic cleavage. Any signal transduction component or components of a signaling transduction pathway may find use in a binding-triggered transcriptional switch whether or not proteolytic cleavage is necessary for signal propagation. For example, in some instances, a phosphorylation-based binding transducer, including but not limited to e.g., one or more signal transduction components of the Jak-Stat pathway, may find use in a non-proteolytic binding-triggered transcriptional switch.

For simplicity, binding-triggered transcriptional switches, including but not limited to chimeric notch receptor polypeptides, are described primarily as single polypeptide chains. However, as will be clear from the instant disclosure, binding-triggered transcriptional switches, including chimeric notch receptor polypeptides, may be divided or split across two or more separate polypeptide chains where the joining of the two or more polypeptide chains to form a functional binding-triggered transcriptional switch, e.g., a chimeric notch receptor polypeptide, may be constitutive or conditionally controlled. For example, constitutive joining of two portions of a split binding-triggered transcriptional switch may be achieved by inserting a constitutive heterodimerization domain between the first and second portions of the split polypeptide such that upon heterodimerization the split portions are functionally joined.

In some instances, the joining of a split binding-triggered transcriptional switch and/or the signaling from a split binding-triggered transcriptional switch may be conditionally controlled through the use of an "adapter" that mediates the functional joining, e.g., of first and second parts of a split binding-triggered transcriptional switch. To mediate signaling through a split binding-triggered transcriptional switch the adapter may be added or administered directly or may be indirectly produced, e.g., through expression of the adapter from a cell configured for such expression, e.g., either conditionally or constitutively. Useful adapters include those proteins having a first and second binding surface that can be simultaneously utilized by two different binding molecules. In some instances, adapters may include proteins for which two antibodies bind to two different epitopes of the protein.

For example, in some instances, an antigen may find use as an adaptor where the binding molecules utilized may be two different antibodies that bind to two different epitopes of the antigen. In such a configuration, attachment of the antibodies, or portions thereof, to the first and second parts of the split binding-triggered transcriptional switch results in functional joining of the parts in the presence of the antigen as mediated by simultaneous binding of both antibodies to a single molecule of the antigen. Antigens that can function as adaptors include, but are not limited to, antigens of a pathogen, cancer-associated antigens, disease-associated antigens, antibodies, and the like. In some cases, the adaptor antigen is soluble (e.g., not bound to the surface of a cell). In some cases, the adaptor antigen is bound to the surface of a cell.

For example, in some instances GFP may find use as an adaptor where the binding molecules utilized may be two different antibodies that bind to two different surfaces of GFP. In such a configuration, attachment of the antibodies, or portions thereof, to the first and second parts of the split binding-triggered transcriptional switch results in functional joining of the parts in the presence of GFP as mediated by simultaneous binding of both antibodies to a single molecule of GFP.

In some instances, a split binding-triggered transcriptional switch, e.g., where binding of the first and second parts of the split binding-triggered transcriptional switch is mediated by an antigen adaptor and results in functional joining of the parts, the split binding-triggered transcriptional switch allows for detection of the presence of the antigen in the vicinity of the first and second parts of the split binding-triggered transcriptional switch. For example, in certain embodiments, a first part of a binding-triggered transcriptional switch expressed on the surface of a first cell and a second part of a binding-triggered transcriptional switch is expressed on a second cell and such first and second parts are configured such that when a soluble antigen is present in the vicinity of the first and second cells the first and second parts are functionally joined by the antigen resulting in activation of a reporter by the activated binding-triggered transcriptional switch.

Both parts of the split binding-triggered transcriptional switch need not necessarily be anchored to a cell to function in the detection of an antigen. For example, in some instances, a first part of a binding-triggered transcriptional switch is solubly expressed and a second part of a binding-triggered transcriptional switch is expressed on a cell and such first and second parts are configured such that when a soluble antigen is present in the vicinity of the first and second parts the parts are functionally joined by the antigen resulting in priming of the binding-triggered transcription switch making the primed binding-triggered transcription switch capable of responding, e.g., reporting, a second event including e.g., the presence of a second antigen that activates the binding-triggered transcriptional switch. Such a second antigen may be present on the surface of a cell or may not be attached to a cell (i.e., soluble).

Conditional control of the joining of the portions of a split binding-triggered transcriptional switch provides further control of signaling from the split binding-triggered transcriptional switch. For example, by mediating joining by providing or expressing an adaptor signaling from the split binding-triggered transcriptional switch a situation permissive to signaling from the switch is created. Conversely, by inhibiting joining by providing a competitive inhibitor that prevents joining of the portions of a split binding-triggered transcriptional switch a signaling from the switch may be prevented. In some instances, such effects are dose dependent, i.e., can be further controlled based on the amount of provided adapter and/or competitive inhibitor.

Accordingly, given the descriptions of split binding-triggered transcriptional switches provided herein and the descriptions of single polypeptide binding-triggered transcriptional switches an ordinary skilled artisan will readily understand wherein split polypeptides may be utilized to provide additional constitutive and/or conditional control over the signaling from such switches and molecular circuits containing such switches.

Chimeric Notch Receptor Polypeptides

The present disclosure provides chimeric Notch receptor polypeptides. A chimeric Notch receptor polypeptide of the present disclosure comprises: a) an extracellular domain comprising a first member of a specific binding pair; b) a Notch receptor polypeptide, where the Notch receptor polypeptide has a length of from 50 amino acids to 1000 amino acids, and comprises one or more ligand-inducible proteolytic cleavage sites; and c) an intracellular domain Binding of the first member of the specific binding pair to a second member of the specific binding pair induces cleavage of the Notch receptor polypeptide at the one or more ligand-inducible proteolytic cleavage sites, thereby releasing the intracellular domain. Release of the intracellular domain modulates an activity of a cell that produces the chimeric Notch receptor polypeptide. The extracellular domain comprises a first member of a specific binding pair; the first member of a specific binding pair comprises an amino acid sequence that is heterologous to the Notch receptor polypeptide. The intracellular domain comprises an amino acid sequence that is heterologous to the Notch receptor polypeptide.

A schematic depiction of a Notch receptor polypeptide is provided in FIG. 1. The Notch receptor polypeptide depicted in FIG. 1 includes: a) an extracellular portion that includes: i) epidermal growth factor (EGF) repeats; ii) a ligand binding site; iii) three Lin-12 Notch repeats (LNR), designated LNR-A, LNR-B, and LNR-C; iv) two heterodimerization domains (HD-N and HD-C); b) a transmembrane (TM) portion; and c) an intracellular portion that includes: i) a RAM domain; ii) ankyrin repeats; iii) a transcription activation domain; and iv) a PEST region. A Notch receptor polypeptide includes three proteolytic sites, termed S1, S2, and S3. S1, a furin cleavage site, is located between HD-N and HC-C; S2, an ADAM17 cleavage site, is located within HD-C; and S3, a gamma secretase cleavage site, is within the TM portion. A Notch receptor polypeptide mediates cell-to-cell communication, e.g. communication between contacting cells, in which one contacting cell is a "receiver" cell and the other contacting cell is a "sender" cell. Engagement of a Notch receptor polypeptide present on a receiving cell by a Delta polypeptide ("ligand") present on a sending cell results in ligand-induced cleavage of the Notch receptor polypeptide, resulting in release of the intracellular portion of the receptor from the membrane into the cytoplasm. The released portion alters receiver cell behavior by functioning as a transcriptional regulator.

Extracellular Domain

As noted above, a chimeric Notch receptor polypeptide of the present disclosure comprises an extracellular domain. The extracellular domain comprises a first member of a specific binding pair. The first member of the specific binding pair binds to a second member of the specific binding pair, where the second member of the specific binding pair is on a polypeptide that is different from the chimeric Notch receptor polypeptide of the present disclosure. The second member of the specific binding pair is separate from (e.g., not covalently linked to) the chimeric Notch receptor polypeptide comprising extracellular domain comprises a first member of the specific binding pair. The second member of the specific binding pair can be present on the surface of a cell. The second member of the specific binding pair can be immobilized on an insoluble support. The second member of the specific binding pair can be soluble. The second member of the specific binding pair can be present in an extracellular environment (e.g., extracellular matrix). The second member of the specific binding pair can be present in an artificial matrix. The second member of the specific binding pair can be present in an acellular environment.

The extracellular domain comprises a first member of a specific binding pair that is heterologous to the Notch receptor polypeptide. In other words, the first member of the specific binding pair present in the extracellular domain is not naturally present in a Notch receptor polypeptide.

Suitable first members of a specific binding pairs include, but are not limited to, antibody-based recognition scaffolds;

antibodies (i.e., an antibody-based recognition scaffold, including antigen-binding antibody fragments); non-antibody-based recognition scaffolds; antigens (e.g., endogenous antigens; exogenous antigens; etc.); a ligand for a receptor; a target of a non-antibody-based recognition scaffold; an Fc receptor (e.g., FcγRIIIa; FcγRIIIb; etc.); an extracellular matrix component; and the like.

Specific binding pairs include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

Non-limiting examples of suitable extracellular domains include, e.g., Cadherins (CDH1-20), Integrins (alfa and beta isoforms), Ephrins, NCAMs, connexins, CD44, syndecan, CD47, DGalfa/beta, SV2, protocadherin, Fas, Dectin-1, CD7, CD40, Neuregulin, KIR, BTLA, Tim-2, Lag-3, CD19, CTLA4, CD28, TIGIT, and ICOS.

In some cases, the extracellular domain comprises a toll-like receptor (TLR). In some cases, the extracellular domain comprises a dectin that recognizes N-glycans that are present on the surface of pathogenic fungi and cancer cells. See, e.g., Xie (2012) *Glycoconj.* 29:273; and Brown et al. (2007) *Protein Sci.* 16:1042. In some cases, the extracellular domain comprises a polypeptide that recognizes a bacterial surface molecule.

In some cases, the extracellular domain of a chimeric Notch polypeptide of the present disclosure comprises an amino acid sequence having at least 75%, at least 80%, at least 85%, at least 90%, at least 95%, at least 98%, at least 99%, or 100%, amino acid sequence identity to the following amino acid sequence: GVLSSPCPPNWIIYEKSCYLF-SMSLNSWDGSKRQCWQLGSNLLKIDSSNELG-FIVKQVSS QPDNSFWIGLSRPQTEVPWLWEDGSTFSSNLFQIRT-TATQENPSPNCVWIHVSVIYDQLC SVPSYSICEK-KFSM (SEQ ID NO:3).

A skilled artisan can select an extracellular domain based on the desired localization or function of a cell that is genetically modified to express a chimeric Notch receptor polypeptide of the present disclosure. For example, the extracellular domain can target cells to estrogen-dependent breast cancer cells that have an increased number of estrogen receptors on the cell surface, where the first member of the specific binding pair binds to an estrogen receptor (second member of the specific binding pair). Other non-limiting examples of ligand/receptor interactions include CCRI (e.g., for targeting to inflamed joint tissues or brain in rheumatoid arthritis, and/or multiple sclerosis), CCR7, CCR8 (e.g., targeting to lymph node tissue), CCR6, CCR9, CCRIO (e.g., to target to intestinal tissue), CCR4, CCRIO (e.g., for targeting to skin), CXCR4 (e.g., for general enhanced transmigration), HCELL (e.g., for targeting of inflammation and inflammatory disorders, bone marrow), Alpha4beta7 (e.g., for intestinal mucosa targeting), VLA-4/VCAM-I (e.g., targeting to endothelium). In general, any receptor involved in targeting (e.g., cancer metastasis) can be used as an extracellular domain of a chimeric Notch receptor polypeptide of the present disclosure.

Antibody-Based Recognition Scaffolds

In some cases, the first member of the specific binding pair is an antibody. The antibody can be any antigen-binding antibody-based polypeptide, a wide variety of which are known in the art. In some instances, the antigen-binding domain is a single chain Fv (scFv). Other antibody based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing VαVβ) are also suitable for use.

Where the member of a specific binding pair in a chimeric Notch receptor polypeptide of the present disclosure is an antibody-based recognition scaffold, the chimeric Notch receptor polypeptide can be activated in the presence of a second member of the specific binding pair, where the second member of the specific binding pair is an antigen that binds to the antibody-based recognition scaffold.

An antibody suitable for inclusion in a chimeric Notch polypeptide of the present disclosure can have a variety of antigen-binding specificities.

In some cases, the antigen-binding domain is specific for an epitope present in an antigen that is expressed by (synthesized by) a cancer cell, i.e., a cancer cell associated antigen. The cancer cell associated antigen can be an antigen associated with, e.g., a breast cancer cell, a B cell lymphoma, a pancreatic cancer, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma cell, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer cell associated antigen may also be expressed by a non-cancerous cell.

In some cases, the antigen-binding domain is specific for an epitope present in a tissue-specific antigen. In some cases, the antigen-binding domain is specific for an epitope present in a disease-associated antigen.

Non-limiting examples of antigens to which an antigen-binding domain of a subject chimeric Notch receptor polypeptide can bind include, e.g., CD19, CD20, CD38, CD30, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like.

Non-limiting examples of antigens to which an antigen-binding domain of a subject chimeric Notch receptor polypeptide can bind include, e.g., Cadherins (CDH1-20), Integrins (alfa and beta isoforms), Ephrins, NCAMs, connexins, CD44, syndecan, CD47, DGalfa/beta, SV2, protocadherin, Fas, Dectin-1, CD7, CD40, Neuregulin, KIR, BTLA, Tim-2, Lag-3, CD19, CTLA4, CD28, TIGIT, and ICOS.

In some cases, the antibody is specific for a cytokine. In some cases, the antibody is specific for a cytokine receptor. In some cases, the antibody is specific for a growth factor. In some cases, the antibody is specific for a growth factor receptor. In some cases, the antibody is specific for a cell-surface receptor.

In some cases, the antibody is specific for a cell surface target, where non-limiting examples of cell surface targets include CD19, CD30, Her2, CD22, ENPP3, EGFR, CD20, CD52, CD 11a, and alpha-integrin.

In some cases, the antigen (second member of the specific binding pair) bound by the antibody-based scaffold is soluble. In some cases, the antigen is membrane-bound, e.g., in some cases, the antigen is present on the surface of a cell. In some cases, the antigen is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the antigen is present in an extracellular matrix (ECM) (e.g., the antigen is an ECM component). In some cases, the antigen is present in an artificial matrix. In some cases, the antigen is present in an acellular environment.

Non-Antibody-Based Recognition Scaffolds

In some cases, the first member of the specific binding pair is a non-antibody-based recognition scaffold. Where the member of a specific binding pair in a chimeric Notch receptor polypeptide of the present disclosure is a non-antibody-based recognition scaffold, the chimeric Notch receptor polypeptide can be activated in the presence of a second member of the specific binding pair, where the second member of the specific binding pair is a target that binds to the non-antibody-based recognition scaffold.

Non-antibody-based recognition scaffolds include, e.g., an affibodies; engineered Kunitz domains; monobodies (adnectins); anticalins; designed ankyrin repeat domains (DARPins); a binding site of a cysteine-rich polypeptide (e.g., cysteine-rich knottin peptides); avimers; afflins; and the like. See, e.g., Gebauer and Skerra (2009) *Curr. Opin. Chem. Biol.* 13:245.

Non-antibody-based scaffolds (also referred to herein as "antibody mimic molecules") may be identified by selection or isolation of a target-binding variant from a library of binding molecules having artificially diversified binding sites. Diversified libraries can be generated using completely random approaches (e.g., error-prone polymerase chain reaction (PCR), exon shuffling, or directed evolution) or aided by art-recognized design strategies. For example, amino acid positions that are usually involved when the binding site interacts with its cognate target molecule can be randomized by insertion of degenerate codons, trinucleotides, random peptides, or entire loops at corresponding positions within the nucleic acid which encodes the binding site (see e.g., U.S. Pub. No. 20040132028). The location of the amino acid positions can be identified by investigation of the crystal structure of the binding site in protein entity with the target molecule. Candidate positions for randomization include loops, flat surfaces, helices, and binding cavities of the binding site. In certain embodiments, amino acids within the binding site that are likely candidates for diversification can be identified by their homology with the immunoglobulin fold. For example, residues within the CDR-like loops of fibronectin may be randomized to generate a library of fibronectin binding molecules (see, e.g., Koide et al., J. Mol. Biol., 284: 1141-1151 (1998)). Other portions of the binding site which may be randomized include flat surfaces. Following randomization, the diversified library may then be subjected to a selection or screening procedure to obtain binding molecules with the desired binding characteristics. For example, selection can be achieved by art-recognized methods such as phage display, yeast display, or ribosome display.

For example, in some cases, the non-antibody-based scaffold comprises a binding site from a fibronectin binding molecule. Fibronectin binding molecules (e.g., molecules comprising the Fibronectin type I, II, or III domains) display CDR-like loops which, in contrast to immunoglobulins, do not rely on intra-chain disulfide bonds. The FnIII loops comprise regions that may be subjected to random mutation and directed evolutionary schemes of iterative rounds of target binding, selection, and further mutation in order to develop useful therapeutic tools. Fibronectin-based "addressable" therapeutic binding molecules ("FATBIM") can be developed to specifically bind the target antigen or epitope. Methods for making fibronectin binding polypeptides are described, for example, in WO 01/64942 and in U.S. Pat. Nos. 6,673,901, 6,703,199, 7,078,490, and 7,119,171.

As another example, in some cases, the non-antibody-based scaffold comprises a binding site from an affibody. Affibodies are derived from the immunoglobulin binding domains of staphylococcal Protein A (SPA) (see e.g., Nord et al., Nat. Biotechnol., 15: 772-777 (1997)). An affibody is an antibody mimic that has unique binding sites that bind specific targets. Affibodies can be small (e.g., consisting of three alpha helices with 58 amino acids and having a molar mass of about 6 kDa), have an inert format (no Fc function), and have been successfully tested in humans as targeting moieties. Affibody binding sites can be synthesized by mutagenizing an SPA-related protein (e.g., Protein Z) derived from a domain of SPA (e.g., domain B) and selecting for mutant SPA-related polypeptides having binding affinity for a target antigen or epitope. Other methods for making affibody binding sites are described in U.S. Pat. Nos. 6,740,734 and 6,602,977 and in WO 00/63243.

As another example, in some cases, the non-antibody-based scaffold comprises a binding site from an anticalin. An anticalin is an antibody functional mimetic derived from a human lipocalin. Lipocalins are a family of naturally-occurring binding proteins that bind and transport small hydrophobic molecules such as steroids, bilins, retinoids, and lipids. The main structure of an anticalin is similar to wild type lipocalins. The central element of this protein architecture is a beta-barrel structure of eight antiparallel strands, which supports four loops at its open end. These loops form the natural binding site of the lipocalins and can be reshaped in vitro by extensive amino acid replacement, thus creating novel binding specificities. Anticalins possess high affinity and specificity for their ligands as well as fast binding kinetics, so that their functional properties are similar to those of antibodies. Anticalins are described in, e.g., U.S. Pat. No. 7,723,476.

As another example, in some cases, the non-antibody-based scaffold comprises a binding site from a cysteine-rich polypeptide. Cysteine-rich domains in some cases do not form an alpha-helix, a beta-sheet, or a beta-barrel structure. In some cases, the disulfide bonds promote folding of the domain into a three-dimensional structure. In some cases, cysteine-rich domains have at least two disulfide bonds, e.g., at least three disulfide bonds. An exemplary cysteine-rich polypeptide is an A domain protein. A-domains (sometimes called "complement-type repeats") contain about 30-50 or 30-65 amino acids. In some cases, the domains comprise about 35-45 amino acids and in some cases about 40 amino acids. Within the 30-50 amino acids, there are about 6 cysteine residues. Of the six cysteines, disulfide bonds typically are found between the following cysteines: C1 and C3, C2 and C5, C4 and C6. The A domain constitutes a ligand binding moiety. The cysteine residues of the domain are disulfide linked to form a compact, stable, functionally independent moiety. Clusters of these repeats make up a ligand binding domain, and differential clustering can impart specificity with respect to the ligand binding. Exemplary proteins containing A-domains include, e.g., complement components (e.g., C6, C7, C8, C9, and Factor I), serine proteases (e.g., enteropeptidase, matriptase, and corin), transmembrane proteins (e.g., ST7, LRP3, LRP5 and LRP6) and endocytic receptors (e.g. Sortilin-related receptor, LDL-receptor, VLDLR, LRP1, LRP2, and ApoER2). Methods for making A-domain proteins of a desired binding specificity are disclosed, for example, in WO 02/088171 and WO 04/044011.

As another example, in some cases, the non-antibody-based scaffold comprises a binding site from a repeat protein. Repeat proteins are proteins that contain consecutive copies of small (e.g., about 20 to about 40 amino acid residues) structural units or repeats that stack together to form contiguous domains. Repeat proteins can be modified to suit a particular target binding site by adjusting the number of repeats in the protein. Exemplary repeat proteins include designed ankyrin repeat proteins (i.e., a DARPins) (see e.g., Binz et al., Nat. Biotechnol., 22: 575-582 (2004)) or leucine-rich repeat proteins (i.e., LRRPs) (see e.g., Pancer et al., Nature, 430: 174-180 (2004)). As another example, in some cases, the non-antibody-based scaffold comprises a DARPin.

As used herein, the term "DARPin" refers to a genetically engineered antibody mimetic protein that typically exhibits highly specific and high-affinity target protein binding. DARPins were first derived from natural ankyrin proteins. In some cases, DARPins comprise three, four or five repeat motifs of an ankyrin protein. In some cases, a unit of an ankyrin repeat consists of 30-34 amino acid residues and functions to mediate protein-protein interactions. In some cases, each ankyrin repeat exhibits a helix-turn-helix conformation, and strings of such tandem repeats are packed in a nearly linear array to form helix-turn-helix bundles connected by relatively flexible loops. In some cases, the global structure of an ankyrin repeat protein is stabilized by intra- and inter-repeat hydrophobic and hydrogen bonding interactions. The repetitive and elongated nature of the ankyrin repeats provides the molecular bases for the unique characteristics of ankyrin repeat proteins in protein stability, folding and unfolding, and binding specificity. The molecular mass of a DARPin domain can be from about 14 or 18 kDa for four- or five-repeat DARPins, respectively. DARPins are described in, e.g., U.S. Pat. No. 7,417,130. In some cases, tertiary structures of ankyrin repeat units share a characteristic composed of a beta-hairpin followed by two antiparallel alpha-helices and ending with a loop connecting the repeat unit with the next one. Domains built of ankyrin repeat units can be formed by stacking the repeat units to an extended and curved structure. LRRP binding sites from part of the adaptive immune system of sea lampreys and other jawless fishes and resemble antibodies in that they are formed by recombination of a suite of leucine-rich repeat genes during lymphocyte maturation. Methods for making DARpin or LRRP binding sites are described in WO 02/20565 and WO 06/083275.

As another example, in some cases, the non-antibody-based scaffold comprises a binding site derived from Src homology domains (e.g. SH2 or SH3 domains), PDZ domains, beta-lactamase, high affinity protease inhibitors, or small disulfide binding protein scaffolds such as scorpion toxins. Methods for making binding sites derived from these molecules have been disclosed in the art, see e.g., Panni et al., J. Biol. Chem., 277: 21666-21674 (2002), Schneider et al., Nat. Biotechnol., 17: 170-175 (1999); Legendre et al., Protein Sci., 11:1506-1518 (2002); Stoop et al., Nat. Biotechnol., 21: 1063-1068 (2003); and Vita et al., PNAS, 92: 6404-6408 (1995). Yet other binding sites may be derived from a binding domain selected from the group consisting of an EGF-like domain, a Kringle-domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, a Laminin-type EGF-like domain, a C2 domain, a binding domain derived from tetranectin in its monomeric or trimeric form, and other such domains known to those of ordinary skill in the art, as well as derivatives and/or variants thereof. Exemplary non-antibody-based scaffolds, and methods of making the same, can also be found in Stemmer et al., "Protein scaffolds and uses thereof", U.S. Patent Publication No. 20060234299 (Oct. 19, 2006) and Hey, et al., Artificial, Non-Antibody Binding Proteins for Pharmaceutical and Industrial Applications, TRENDS in Biotechnology, vol. 23, No. 10, Table 2 and pp. 514-522 (October 2005).

As another example, in some cases, the non-antibody-based scaffold comprises a Kunitz domain. The term "Kunitz domains" as used herein, refers to conserved protein domains that inhibit certain proteases, e.g., serine proteases. Kunitz domains are relatively small, typically being about 50 to 60 amino acids long and having a molecular weight of about 6 kDa. Kunitz domains typically carry a basic charge and are characterized by the placement of two, four, six or eight or more that form disulfide linkages that contribute to the compact and stable nature of the folded peptide. For example, many Kunitz domains have six conserved cysteine residues that form three disulfide linkages. The disulfide-rich α/β fold of a Kunitz domain can include two, three (typically), or four or more disulfide bonds.

Kunitz domains have a pear-shaped structure that is stabilized the, e.g., three disulfide bonds, and that contains a reactive site region featuring the principal determinant P1 residue in a rigid confirmation. These inhibitors competitively prevent access of a target protein (e.g., a serine protease) for its physiologically relevant macromolecular substrate through insertion of the P1 residue into the active site cleft. The P1 residue in the proteinase-inhibitory loop provides the primary specificity determinant and dictates much of the inhibitory activity that particular Kunitz protein has toward a targeted proteinase. In general, the N-terminal side of the reactive site (P) is energetically more important that the P' C-terminal side. In most cases, lysine or arginine occupy the P1 position to inhibit proteinases that cleave adjacent to those residues in the protein substrate. Other residues, particularly in the inhibitor loop region, contribute to the strength of binding. Generally, about 10-12 amino acid residues in the target protein and 20-25 residues in the proteinase are in direct contact in the formation of a stable proteinase-inhibitor protein entity and provide a buried area of about 600 to 900 A. By modifying the residues in the P site and surrounding residues Kunitz domains can be designed to target a protein of choice. Kunitz domains are described in, e.g., U.S. Pat. No. 6,057,287.

As another example, in some cases, the non-antibody-based scaffold is an affilin Affilins are small antibody-mimic proteins which are designed for specific affinities towards proteins and small compounds. New affilins can be very quickly selected from two libraries, each of which is based on a different human derived scaffold protein. Affilins do not show any structural homology to immunoglobulin proteins. There are two commonly-used affilin scaffolds, one of which is gamma crystalline, a human structural eye lens protein and the other is "ubiquitin" superfamily proteins. Both human scaffolds are very small, show high temperature stability and are almost resistant to pH changes and denaturing agents. This high stability is mainly due to the expanded beta sheet structure of the proteins. Examples of gamma crystalline derived proteins are described in WO200104144 and examples of "ubiquitin-like" proteins are described in WO2004106368.

As another example, in some cases, the non-antibody-based scaffold is an Avimer. Avimers are evolved from a large family of human extracellular receptor domains by in vitro exon shuffling and phage display, generating multidomain proteins with binding and inhibitory properties Linking multiple independent binding domains has been shown to create avidity and results in improved affinity and specificity compared with conventional single-epitope binding proteins. In certain embodiments, Avimers consist of two or more peptide sequences of 30 to 35 amino acids each, connected by spacer region peptides. The individual sequences are derived from A domains of various membrane receptors and have a rigid structure, stabilized by disulfide bonds and calcium. Each A domain can bind to a certain epitope of the target protein. The combination of domains binding to different epitopes of the same protein increases affinity to this protein, an effect known as avidity (hence the name). Avimers with sub-nanomolar affinities have been obtained against a variety of targets. Alternatively, the domains can be directed against epitopes on different target proteins. Additional information regarding avimers can be found in U.S. patent application Publication Nos. 2006/0286603, 2006/0234299, 2006/0223114, 2006/0177831, 2006/0008844, 2005/0221384, 2005/0164301, 2005/0089932, 2005/0053973, 2005/0048512, 2004/0175756.

Suitable targets of a non-antibody-based scaffold include any of the above-mentioned antigens to which an antibody-based scaffold can bind.

In some cases, the target (second member of the specific binding pair) bound by the non-antibody-based scaffold is soluble. In some cases, the target is membrane-bound, e.g., in some cases, the target is present on the surface of a cell. In some cases, the target is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the target is present in an extracellular matrix (ECM) (e.g., the antigen is an ECM component). In some cases, the target is present in an artificial matrix. In some cases, the target is present in an acellular environment.

Cell Adhesion Molecules

In some cases, the first member of the specific binding pair is a cell adhesion molecule (CAM), i.e., a polypeptide that binds a component of an extracellular matrix (ECM) or that binds a cell surface molecule. For example, in some cases, the first member of the specific binding pair is the extracellular region of a CAM. In some cases, the CAM is a calcium-independent adhesion molecule; for example, in some cases, the CAM is an immunoglobulin superfamily CAM. In some cases, the CAM is a calcium-dependent adhesion molecule; e.g., the CAM is an integrin, a cadherin, or a selectin. In some cases, the first member of the specific binding pair is an integrin. In some cases, the first member of the specific binding pair is a cadherin, e.g., an E-cadherin, a P-cadherin, an N-cadherin, an R-cadherin, an M-cadherin, etc. In some cases, the first member of the specific binding pair is a selectin, e.g., an E-selectin, an L-selectin, or a P-selectin. Binding fragments of a CAM can be used as the first member of the specific binding pair.

Where the first member of the specific binding pair is a CAM, the second member of the specific binding pair is a component of ECM or a cell surface molecule that binds the CAM. For example, where the first member of the specific binding pair is an integrin, the second member of the specific binding pair is a component of collagen, fibrinogen, fibronectin, or vitronectin. As another example, where the first member of the specific binding pair is cadherin, the second member of the specific binding pair is cell surface antigen bound by the cadherin. As another example, where the first member of the specific binding pair is a selectin, the second member of the specific binding pair is a fucosylated carbohydrate.

Ligands

In some cases, the first member of the specific binding pair is a ligand for a receptor. Ligands include polypeptides, nucleic acids, glycoproteins, small molecules, carbohydrates, lipids, glycolipids, lipoproteins, lipopolysaccharides, etc. In some cases, the ligand is soluble.

Ligands include, but are not limited to, cytokines (e.g., IL-13, etc.); growth factors (e.g., heregulin; vascular endothelial growth factor (VEGF); and the like); peptide hormones; an integrin-binding peptide (e.g., a peptide comprising the sequence Arg-Gly-Asp); an N-glycan; and the like.

Where the member of a specific binding pair in a chimeric Notch receptor polypeptide of the present disclosure is a ligand, the chimeric Notch receptor polypeptide can be activated in the presence of a second member of the specific binding pair, where the second member of the specific binding pair is a receptor for the ligand. For example, where the ligand is VEGF, the second member of the specific binding pair can be a VEGF receptor, including a soluble VEGF receptor. Alternatively, the first member of the specific binding pair can be a VEGF receptor; and the first member of the specific binding pair can be VEGF. As another example, where the ligand is heregulin, the second member of the specific binding pair can be Her2.

Where the first member of the specific binding pair is a ligand, the second member of the specific binding pair is a molecule that binds the ligand, e.g., the second member of the specific binding pair is an antibody that specifically binds the ligand, a receptor for the ligand, etc.

Where the first member of the specific binding pair is a ligand, in some cases, the second member of the specific binding pair (the molecule that binds the ligand) is soluble. In some cases, the second member of the specific binding pair is membrane-bound, e.g., in some cases, the second member of the specific binding pair is present on the surface of a cell. In some cases, the second member of the specific binding pair is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the second member of the specific binding pair is present in an acellular environment.

Antigens

In some cases, the first member of the specific binding pair is an antigen to which an antibody specifically binds. The antigen can be any antigen, e.g., a naturally-occurring (endogenous) antigen; a synthetic (e.g., modified in such a way that it is no longer the same as a naturally-occurring antigen; modified from its natural state; etc.) antigen; etc.

Where the member of a specific binding pair in a chimeric Notch receptor polypeptide of the present disclosure is an antigen, the chimeric Notch receptor polypeptide can be activated in the presence of a second member of the specific binding pair, where the second member of the specific binding pair is an antibody (antibody-based recognition scaffold) that binds to the antigen.

In some cases, the antigen is a disease-associated antigen, e.g., a cancer-associated antigen, an autoimmune disease-associated antigen, a pathogen-associated antigen, an inflammation-associated antigen, or the like.

For example, where the second member of the specific binding pair is an antibody specific for a cancer-associated antigen, the antigen can be a cancer-associated antigen, where cancer-associated antigens include, e.g., CD19, CD20, CD38, CD30, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Cancer-associated antigens also include, e.g., 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CEA, CNTO888, CTLA-4, DR5, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin α5β1, integrin αvβ3, MORAb-009, MS4A1, MUC1, mucin CanAg, N-glycolylneuraminic acid, NPC-1C, PDGF-R α, PDL192, phosphatidylserine, prostatic carcinoma cells, RANKL, RON, ROR1, SCH 900105, SDC1, SLAMF7, TAG-72, tenascin C, TGF beta 2, TGF-β, TRAIL-R1, TRAIL-R2, tumor antigen CTAA16.88, VEGF-A, VEGFR-1, VEGFR2, and vimentin.

The antigen can be associated with an inflammatory disease. Non-limiting examples of antigens associated with inflammatory disease include, e.g., AOC3 (VAP-1), CAM-3001, CCL11 (eotaxin-1), CD125, CD147 (basigin), CD154 (CD40L), CD2, CD20, CD23 (IgE receptor), CD25 (α chain of IL-2 receptor), CD3, CD4, CD5, IFN-α, IFN-γ, IgE, IgE Fc region, IL-1, IL-12, IL-23, IL-13, IL-17, IL-17A, IL-22, IL-4, IL-5, IL-5, IL-6, IL-6 receptor, integrin α4, integrin α4β7, LFA-1 (CD11a), myostatin, OX-40, scleroscin, SOST, TGF beta 1, TNF-α, and VEGF-A.

Where the first member of the specific binding pair is an antigen, the second member of the specific binding pair can be an antibody-based scaffold (e.g., an antibody) or a non-antibody-based scaffold. In some cases, the second member of the specific binding pair is present on the surface of a cell. In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Targets of Non-Antibody-Based Recognition Scaffolds

In some cases, the first member of the specific binding pair is a target of a non-antibody-based scaffold. Targets include, e.g., polypeptides, nucleic acids, glycoproteins, small molecules, carbohydrates, lipids, glycolipids, lipoproteins, lipopolysaccharides, etc.

Where the first member of the specific binding pair is a target of a non-antibody-based scaffold, the second member of the specific binding pair is a non-antibody-based scaffold.

Receptors

In some cases, the first member of the specific binding pair is a receptor. In some cases, the receptor is a growth factor receptor. In some cases, the receptor is a cytokine receptor. In some cases, the receptor is a cell surface receptor that binds to a co-receptor on a cell. In some cases, the receptor is a neurotransmitter receptor. In some cases, the receptor binds to an extracellular matrix component. In some cases, the receptor is an immunoglobulin Fc receptor.

Suitable receptors include, but are not limited to, a growth factor receptor (e.g., a VEGF receptor); a killer cell lectin-like receptor subfamily K, member 1 (NKG2D) polypeptide (receptor for MICA, MICB, and ULB6); a cytokine receptor (e.g., an IL-13 receptor; an IL-2 receptor; etc.); an epidermal growth factor (EGF) receptor; Her2; CD27; a natural cytotoxicity receptor (NCR) (e.g., NKP30 (NCR3/CD337) polypeptide (receptor for HLA-B—associated transcript 3 (BAT3) and B7-H6); etc.); a T cell antigen receptor; a dihydrofolate receptor; a chimeric cytokine receptor; an Fc receptor; an extracellular matrix receptor (e.g. an integrin); a cell adhesion receptor (e.g. a cadherin); an immunoregulatory receptor including both positive co-receptors (e.g. CD28) and negative (immunosuppressive) co-receptors (e.g., PD1); a cytokine receptor; and a receptor for a immunoregulatory molecule (e.g. TGFβ), etc. In some cases, the receptor is truncated, relative to the wild-type receptor.

Where the first member of the specific binding pair is a receptor, the second member of the specific binding pair is target of the receptor, where the target can be a ligand for the receptor, or a co-receptor. In some cases, the second member of the specific binding pair is present on the surface of a cell.

In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Notch Receptor Polypeptide

As noted above, a chimeric Notch receptor polypeptide of the present disclosure comprises a Notch receptor polypeptide having a length of from 50 amino acids to 1000 amino acids and comprising one or more ligand-inducible proteolytic cleavage sites.

In some cases, the Notch receptor polypeptide present in a chimeric Notch receptor polypeptide of the present disclosure has a length of from 50 amino acids (aa) to 1000 aa, e.g., from 50 aa to 75 aa, from 75 aa to 100 aa, from 100 aa to 150 aa, from 150 aa to 200 aa, from 200 aa to 250 aa, from 250 a to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, from 750 aa to 800 aa, from 800 aa to 850 aa, from 850 aa to 900 aa, from 900 aa to 950 aa, or from 950 aa to 1000 aa. In some cases, the Notch receptor polypeptide present in a chimeric Notch receptor polypeptide of the present disclosure has a length of from 300 aa to 400 aa. In some cases, the Notch receptor polypeptide present in a chimeric Notch receptor polypeptide of the present disclosure has a length of from 300 aa to 350 aa. In some cases, the Notch receptor polypeptide present in a chimeric Notch receptor polypeptide of the present disclosure has a length of from 300 aa to 325 aa. In some cases, the Notch receptor polypeptide present in a chimeric Notch receptor polypeptide of the present disclosure has a length of from 350 aa to 400 aa. In some cases, the Notch receptor polypeptide present in a chimeric Notch receptor polypeptide of the present disclosure has a length of from 750 aa to 850 aa. In some cases, the Notch receptor polypeptide present in a chimeric Notch receptor polypeptide of the present disclosure has a length of from 50 aa to 75 aa. In some cases, the Notch receptor polypeptide present in a chimeric Notch receptor polypeptide of the present disclosure has a length of from 310 aa to 320 aa, e.g., 310 aa, 311 aa, 312 aa, 313 aa, 314 aa, 315 aa, 316 aa, 317 aa, 318 aa, 319 aa, or 320 aa. In some cases, the Notch receptor polypeptide present in a chimeric Notch receptor polypeptide of the present disclosure has a length of 315 aa. In some cases, the Notch receptor polypeptide present in a chimeric Notch receptor polypeptide of the present disclosure has a length of from 360 aa to 370 aa, e.g., 360 aa, 361 aa, 362 aa, 363 aa 364 aa, 365 aa, 366 aa, 367 aa, 368 aa, 369 aa, or 370 aa. In some cases, the Notch receptor polypeptide present in a chimeric Notch receptor polypeptide of the present disclosure has a length of 367 aa.

Notch Receptor Polypeptide Comprising a TM Domain

In some cases, the Notch receptor polypeptide present in a chimeric Notch receptor polypeptide of the present disclosure comprises an amino acid sequence having at least 75%, at least 80%, at least 85%, at least 90%, at least 95%, at least 98%, at least 99%, or 100%, amino acid sequence identity to the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; where the Notch receptor polypeptide has a length of from 50 amino acids (aa) to 65 aa, e.g., 50, 51, 52, 53, 54, 55, 56, 57, 58, 59, 60, 61, 62, 63, 64, or 65 aa. In some cases, the Notch receptor polypeptide present in a chimeric Notch receptor polypeptide of the present disclosure comprises an amino acid sequence having at least 75%, at least 80%, at least 85%, at least 90%, at least 95%, at least 98%, at least 99%, or 100%, amino acid sequence identity to the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; where the Notch receptor polypeptide has a length of 56 amino acids.

Figure 4A:
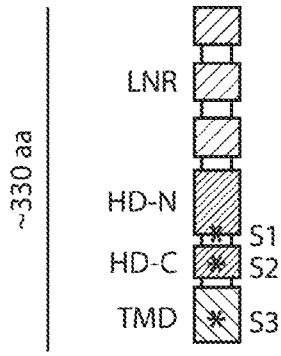
FIGS. 4A-4G provide schematic depictions of exemplary chimeric Notch receptor polypeptides of the present disclosure.

Notch Receptor Polypeptide Comprising an LNR Segment, an HD-N Segment, an HD-C Segment, and a TM Domain In some cases, the Notch receptor polypeptide present in a chimeric Notch receptor polypeptide of the present disclosure comprises, in order from N-terminus to C-terminus: i) a LNR-A segment; ii) a LNR-B segment; iii) a LNR-C segment; iv) an HD-N segment, v) an HD-C segment; and vi) a TM domain A LNR-A segment, LNR-B segment, and LNR-C segment can collectively be referred to as an "LNR segment." Such a Notch receptor polypeptide is depicted schematically in FIG. 4A.

An LNR segment can comprise an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and can have a length of from 90 amino acids to 150 amino acids, e.g., from 90 amino acids (aa) to 100 aa, from 100 aa to 110 aa, from 110 aa to 120 aa, from 120 aa to 130 aa, from 130 aa to 140 aa, or from 140 aa to 150 aa. In some cases, an LNR segment comprises an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and has a length of from 115 aa to 125 aa, e.g., 115, 116, 117, 118, 119, 120, 121, 122, 123, 124, or 125 aa.

An LNR segment can comprise an amino acid sequence having at least 75%, at least 80%, at least 85%, at least 90%, at least 95%, at least 98%, at least 99%, or 100%, amino acid sequence identity to the following amino acid sequence: PPQIEEACELPECQVDAGNKVCNLQCNNHACGWDG-GDCSLNFNDPWKNCTQSLQCWK YFSDGHCDSQCN-SAGCLFDGFDCQLTEGQCNPLYDQYCKDHFSDGH-CDQGCNSAECE WDGLDC (SEQ ID NO:5); and can have a length of from 118 to 122 amino acids (e.g., 118, 119, 120, 121, or 122 amino acids).

An HD-N segment can comprise an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and can have a length of from 90 amino acids (aa) to 110 aa, e.g., 90 aa to 95 aa, 95 aa to 100 aa, 100 aa to 105 aa, or 105 aa to 110 aa. In some cases, an HD-N segment comprises an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and has a length of from 95 aa to 105 aa, e.g., 95, 96, 98, 98, 99, 100, 101, 102, 103, 104, or 105 aa.

An HD-C segment can comprise an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and can have a length of from 60 amino acids (aa) to 80 aa, e.g., from 60 aa to 65 aa, from 65 aa to 70 aa, from 70 aa to 75 aa, or from 75 aa to 80 aa. In some cases, an HD-C segment comprises an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and has a length of from 65 amino acids to 75 amino acids, e.g., 65, 66, 67, 68, 69, 70, 71, 72, 73, 74, or 75 amino acids.

An HD segment (HD-N plus HD-C) can comprise an amino acid sequence having at least 75%, at least 80%, at least 85%, at least 90%, at least 95%, at least 98%, at least 99%, or 100%, amino acid sequence identity to the following amino acid sequence: AAGTLVLVVLLPPDQLRNNS- FHFLRELSHVLHTNVVFKRDAQGQQMIF- PYYGHEEELR KHPIKRSTVGWATSSLLPGTSGGRQRRELDPMDIRG- SIVYLEIDNRQCVQSSSQCFQSAT DVAAFL- GALASLGSLNIPYKIEAVKSEPVEPPLP (SEQ ID NO:6); and can have a length of 150, 151, 152, 153, or 154 amino acids.

A transmembrane segment can comprise an amino acid sequence having at least 75%, at least 80%, at least 85%, at least 90%, at least 95%, at least 98%, at least 99%, or 100%, amino acid sequence identity to amino acids 1736 to 1756 of the amino acid sequence depicted in FIG. 2A, or a corresponding segment of another Notch receptor polypeptide, where examples of corresponding segments are depicted in FIGS. 2B-2G; and can have a length of from 15 amino acids (aa) to 25 amino acids, e.g., 15, 16, 17, 18, 29, 20, 21, 22, 23, 24, or 25 amino acids.

A transmembrane segment can comprise an amino acid sequence having at least 75%, at least 80%, at least 85%, at least 90%, at least 95%, at least 98%, at least 99%, or 100%, amino acid sequence identity to the following amino acid sequence: HLMYVAAAAFVLLFFVGCGVLLS (SEQ ID NO:7); and can have a length of 21, 22, 23, 24, or 25 amino acids.

In some cases, a Notch receptor polypeptide has a length of from about 310 amino acids (aa) to about 320 aa (e.g., 310 aa, 311 aa, 312 aa, 313 aa, 314 aa, 315 aa, 316 aa, 317 aa, 318 aa, 319 aa, or 320 aa), and comprises an amino acid sequence having at least 75%, at least 80%, at least 85%, at least 90%, at least 95%, at least 98%, at least 99%, or 100%, amino acid sequence identity to amino acids 1442-1756 of the amino acid sequence depicted in FIG. 2A, or a corresponding segment of another Notch receptor polypeptide, where examples of corresponding segments are depicted in FIGS. 2B-2G.

In some cases, a Notch receptor polypeptide comprises an amino acid sequence having at least 75%, at least 80%, at least 85%, at least 90%, at least 95%, at least 98%, at least 99%, or 100%, amino acid sequence identity to the following amino acid sequence: PPQIEEACELPECQVDAGNK- VCNLQCNNHACGWDGGDCSLNFNDPWKNCTQS- LQCWK YFSDGHCDSQCNSAGCLFDGFDCQLTEGQCNPLY- DQYCKDHFSDGHCDQGCNSAECE WDGLDCAE- HVPERLAAGTLVLVVLLPPDQLRNNSFHFLRELSHV- LHTNVVFKRDAQGQ QMIFPYYGHEEELRKHPIKRSTVGWATSSLL- PGTSGGRQRRELDPMDIRGSIVYLEIDNR QCVQSSSQCFQSATDVAAFLGALASLG- SLNIPYKIEAVKSEPVEPPLPSQLHLMYVAAAA FVLLFFVGCGVLLS (SEQ ID NO:1); and has a length of from 300 amino acids to 310 amino acids (e.g., 300, 301, 302, 303, 304, 305, 306, 307, 308, 309, or 310 amino acids).

In some cases, a Notch receptor polypeptide comprises an amino acid sequence having at least 75%, at least 80%, at least 85%, at least 90%, at least 95%, at least 98%, at least 99%, or 100%, amino acid sequence identity to the following amino acid sequence: PCVGSNPCYNQGTCEPTSEN- PFYRCLCPAKFNGLLCHILDYSFTGGAGRDIPPPQIEE- ACE LPECQVDAGNKVCNLQCNNHACGWDGGDCSLNF- NDPWKNCTQSLQCWKYFSDGHCD SQCNSAG- CLFDGFDCQLTEGQCNPLYDQYCKDHFSDGH- CDQGCNSAECEWDGLDCAE HVPERLAAGTLVLVVLLPPDQLRNNSFHFLRELSHV- LHTNVVFKRDAQGQQMIFPYYG HEEELRKH- PIKRSTVGWATSSLLPGTSGGRQRRELDPMDIRG- SIVYLEIDNRQCVQSSSQ CFQSATDVAAFLGALASLGSLNIPYKIEAVKSEPVEP- PLPSQLHLMYVAAAAFVLLFFVG CGVLLS (SEQ ID NO:2); and has a length of from 350 amino acids to 370 amino acids (e.g., 350 351, 352, 353, 354, 355, 356, 357, 358, 359, 360, 361, 362, 363, 364, 365, 366, 367, 368, 369, or 370 amino acids).

Figure 4B:
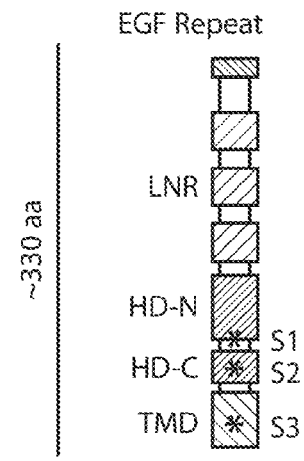

Notch Receptor Polypeptide Comprising a Single EGF Repeat, an LNR Segment, an HD-N Segment, an HD-C Segment, and a TM Domain In some cases, the Notch receptor polypeptide present in a chimeric Notch receptor polypeptide of the present disclosure comprises, in order from N-terminus to C-terminus: i) a single EGF repeat; ii) an LNR segment; iii) an HD-N segment, iv) an HD-C segment; and v) a TM domain. Such a Notch receptor polypeptide is depicted schematically in FIG. 4B.

An EGF repeat can comprises an amino acid sequence having at least 75%, at least 80%, at least 85%, at least 90%, at least 95%, at least 98%, at least 99%, or 100%, amino acid sequence identity to amino acids 1390 to 1430 of the amino acid sequence depicted in FIG. 2A, or a corresponding segment of another Notch receptor polypeptide, where examples of corresponding segments are depicted in FIGS. 2B-2G; and can have a length of from 35 amino acids (aa) to 45 aa (e.g., 35, 36, 37, 38, 39, 40, 41, 42, 43, 44, or 45 aa).

An EGF repeat can comprise an amino acid sequence having at least 75%, at least 80%, at least 85%, at least 90%, at least 95%, at least 98%, at least 99%, or 100%, amino acid sequence identity to the following sequence: PCVGSN- PCYNQGTCEPTSENPFYRCLCPAKFNGLLCH (SEQ ID NO:8); and can have a length of 35 amino acids to 40 amino acids (e.g., 35, 36, 37, 38, 39, or 40 amino acids.

An LNR segment can comprise an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and can have a length of from 90 amino acids to 150 amino acids, e.g., from 90 amino acids (aa) to 100 aa, from 100 aa to 110 aa, from 110 aa to 120 aa, from 120 aa to 130 aa, from 130 aa to 140 aa, or from 140 aa to 150 aa. In some cases, an LNR segment comprises an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and has a length of from 115 aa to 125 aa, e.g., 115, 116, 117, 118, 119, 120, 121, 122, 123, 124, or 125 aa.

An LNR segment can comprise an amino acid sequence having at least 75%, at least 80%, at least 85%, at least 90%, at least 95%, at least 98%, at least 99%, or 100%, amino acid sequence identity to the following amino acid sequence: PPQIEEACELPECQVDAGNKVCNLQCNNHACGWDG-GDCSLNFDPWKNCTQSLQCWK YFSDGHCDSQCN-SAGCLFDGFDCQLTEGQCNPLYDQYCKDHFSDGH-CDQGCNSAECE WDGLDC (SEQ ID NO:5); and can have a length of from 118 to 122 amino acids (e.g., 118, 119, 120, 121, or 122 amino acids).

An HD-N segment can comprise an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and can have a length of from 90 amino acids (aa) to 110 aa, e.g., 90 aa to 95 aa, 95 aa to 100 aa, 100 aa to 105 aa, or 105 aa to 110 aa. In some cases, an HD-N segment comprises an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and has a length of from 95 aa to 105 aa, e.g., 95, 96, 98, 98, 99, 100, 101, 102, 103, 104, or 105 aa.

An HD-C segment can comprise an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and can have a length of from 60 amino acids (aa) to 80 aa, e.g., from 60 aa to 65 aa, from 65 aa to 70 aa, from 70 aa to 75 aa, or from 75 aa to 80 aa. In some cases, an HD-C segment comprises an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and has a length of from 65 amino acids to 75 amino acids, e.g., 65, 66, 67, 68, 69, 70, 71, 72, 73, 74, or 75 amino acids.

An HD segment (HD-N plus HD-C) can comprise an amino acid sequence having at least 75%, at least 80%, at least 85%, at least 90%, at least 95%, at least 98%, at least 99%, or 100%, amino acid sequence identity to the following amino acid sequence: AAGTLVLVVLLPPDQLRNNS-FHFLRELSHVLHTNVVFKRDAQGQQMIF-PYYGHEEELR KHPIKRSTVGWATSSLLPGTSGGRQRRELDPMDIRG-SIVYLEIDNRQCVQSSSQCFQSAT DVAAFL-GALASLGSLNIPYKIEAVKSEPVEPPLP (SEQ ID NO:6); and can have a length of 150, 151, 152, 153, or 154 amino acids.

A transmembrane segment can comprise an amino acid sequence having at least 75%, at least 80%, at least 85%, at least 90%, at least 95%, at least 98%, at least 99%, or 100%, amino acid sequence identity to amino acids 1736 to 1756 of the amino acid sequence depicted in FIG. 2A, or a corresponding segment of another Notch receptor polypeptide, where examples of corresponding segments are depicted in FIGS. 2B-2G; and can have a length of from 15 amino acids (aa) to 25 amino acids, e.g., 15, 16, 17, 18, 29, 20, 21, 22, 23, 24, or 25 amino acids.

A transmembrane segment can comprise an amino acid sequence having at least 75%, at least 80%, at least 85%, at least 90%, at least 95%, at least 98%, at least 99%, or 100%, amino acid sequence identity to the following amino acid sequence: HLMYVAAAAFVLLFFVGCGVLLS (SEQ ID NO:7); and can have a length of 21, 22, 23, 24, or 25 amino acids.

In some cases, a Notch receptor polypeptide has a length of from about 360 amino acids (aa) to about 375 aa (e.g., 360 aa, 361 aa, 362 aa, 363 aa, 364 aa, 365 aa, 366 aa, 367 aa, 368 aa, 369 aa, 370 aa, 371 aa, 372 aa, 373 aa, 374 aa, or 375 aa), and comprises an amino acid sequence having at least 75%, at least 80%, at least 85%, at least 90%, at least 95%, at least 98%, at least 99%, or 100%, amino acid sequence identity to amino acids 1390-1756 of the amino acid sequence depicted in FIG. 2A, or a corresponding segment of another Notch receptor polypeptide, where examples of corresponding segments are depicted in FIGS. 2B-2G.

Figure 4C:
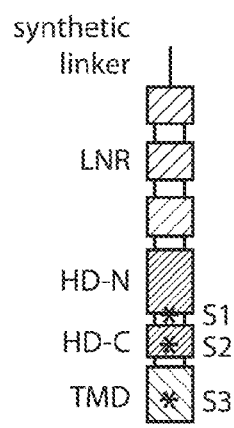

In some cases, a Notch receptor polypeptide comprises a synthetic linker. For example, in some cases, a Notch receptor polypeptide comprises, in order from N-terminus to C-terminus: i) a synthetic linker; ii) an EGF repeat; iii) an LNR segment; iv) an HD-N segment, v) an HD-C segment; and vi) a TM domain. Such a Notch receptor polypeptide is depicted schematically in FIG. 4C.

A synthetic linker can have a length of from about 10 amino acids (aa) to about 200 aa, e.g., from 10 aa to 25 aa, from 25 aa to 50 aa, from 50 aa to 75 aa, from 75 aa to 100 aa, from 100 aa to 125 aa, from 125 aa to 150 aa, from 150 aa to 175 aa, or from 175 aa to 200 aa. A synthetic linker can have a length of from 10 aa to 30 aa, e.g., 10, 11, 12, 13, 14, 15, 16, 17, 18, 19, 20, 21, 22, 23, 24, 25, 26, 27, 28, 29, or 30 aa. A synthetic linker can have a length of from 30 aa to 50 aa, e.g., from 30 aa to 35 aa, from 35 aa to 40 aa, from 40 aa to 45 aa, or from 45 aa to 50 aa.

Figure 4D:
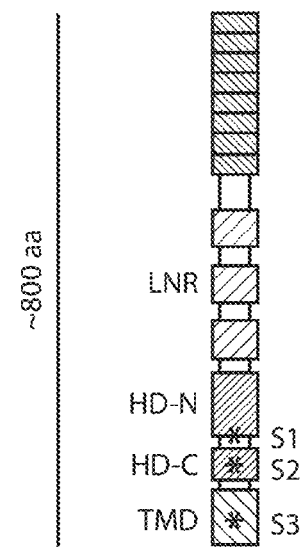

In some instances, a synthetic linker, as described herein, may include an extracellular protein structural domain or a portion thereof. Extracellular protein structural domains suitable for use as a synthetic linker include but are not limited to e.g., Ig-like extracellular structural domains, Fc extracellular structural domains, fibronectin extracellular structural domains and the like. In some instances, a synthetic linker may include a plurality of extracellular protein structural domains where the plurality may include a plurality of the same domain or a plurality of different domains.
Notch Receptor Polypeptide Comprising 2-11 EGF Repeats, an LNR Segment, an HD-N Segment, an HD-C Segment, and a TM Domain In some cases, the Notch receptor polypeptide present in a chimeric Notch receptor polypeptide of the present disclosure comprises, in order from N-terminus to C-terminus: i) from two to eleven EGF repeats; ii) an LNR segment; iii) an HD-N segment, iv) an HD-C segment; and v) a TM domain. Such a Notch receptor polypeptide is depicted schematically in FIG. 4D.

In some cases, the Notch receptor polypeptide present in a chimeric Notch receptor polypeptide of the present disclosure comprises, in order from N-terminus to C-terminus: i) two EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) three EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) four EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) five EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) six EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) seven EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) eight EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) nine EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) ten EGF repeats; ii) an LNR segment; iii) an HD-N segment, iv) an HD-C segment; and v) a TM domain. In some cases, the Notch receptor polypeptide present in a chimeric Notch receptor polypeptide of the present disclosure comprises, in order from N-terminus to C-terminus: i) eleven EGF repeats; ii) an LNR segment; iii) an HD-N segment, iv) an HD-C segment; and v) a TM domain.

An EGF repeat can comprise an amino acid sequence having at least 75%, at least 80%, at least 85%, at least 90%, at least 95%, at least 98%, at least 99%, or 100%, amino acid sequence identity to amino acids 1390 to 1430 of the amino acid sequence depicted in FIG. 2A, or a corresponding segment of another Notch receptor polypeptide, where examples of corresponding segments are depicted in FIGS. 2B-2G; and can have a length of from 35 amino acids (aa) to 45 aa (e.g., 35, 36, 37, 38, 39, 40, 41, 42, 43, 44, or 45 aa).

An EGF repeat can comprise an amino acid sequence having at least 75%, at least 80%, at least 85%, at least 90%, at least 95%, at least 98%, at least 99%, or 100%, amino acid sequence identity to amino acids 869-905 (DINECVLSP-CRHGASCQNTHGGYRCHCQAGYSGRNCE; SEQ ID NO:9) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 907-943 (DIDDCRPN-PCHNGGSCTDGINTAFCDCLPGFRGTFCE; SEQ ID NO:10) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 945-981 (DINECASDP-CRNGANCTDCVDSYTCTCPAGFSGIHCE; (SEQ ID NO:11) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 988-1019 (TESSCFNG-GTCVDGINSFTCLCPPGFTGSYCQ; SEQ ID NO:12) of the amino acid sequence depicted in FIG. 2A, or a corresponding segment of another Notch receptor polypeptide, where examples of corresponding segments are depicted in FIGS. 2B-2G; and can have a length of from 30 amino acids (aa) to 35 aa (e.g., 30, 31, 32, 33, 34, or 35 aa).

An EGF repeat can comprise an amino acid sequence having at least 75%, at least 80%, at least 85%, at least 90%, at least 95%, at least 98%, at least 99%, or 100%, amino acid sequence identity to amino acids 1021-1057 (DVNECD-SQPCLHGGTCQDGCGSYRCTCPQGYTGPNCQ; SEQ ID NO:13) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 1064-1090 (DSSPCKNG-GKCWQTHTQYRCECPSGWT; SEQ ID NO:14) of the amino acid sequence depicted in FIG. 2A, or a corresponding segment of another Notch receptor polypeptide, where examples of corresponding segments are depicted in FIGS. 2B-2G; and can have a length of from 25 amino acids (aa) to 30 aa, e.g., 25, 26, 27, 28, 29, or 30 aa.

An EGF repeat can comprise an amino acid sequence having at least 75%, at least 80%, at least 85%, at least 90%, at least 95%, at least 98%, at least 99%, or 100%, amino acid sequence identity to amino acids 1146-1180 (LVDECSPSP-CQNGATCTDYLGGYSCKCVAGYHGVNC; SEQ ID NO:15) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 1184-1219 (IDECLSHP-CQNGGTCLDLPNTYKCSCPRGTQGVHCE; SEQ ID NO:16) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to amino acids 1238-1265 (CF-NNGTCVDQVGGYSCTCPPGFVGERCE; SEQ ID NO:17) of the amino acid sequence depicted in FIG. 2A, or a corresponding segment of another Notch receptor polypeptide, where examples of corresponding segments are depicted in FIGS. 2B-2G; and can have a length of from 25 amino acids (aa) to 30 aa, e.g., 25, 26, 27, 28, 29, or 30 aa.

An EGF repeat can comprise an amino acid sequence having at least 75%, at least 80%, at least 85%, at least 90%, at least 95%, at least 98%, at least 99%, or 100%, amino acid sequence identity to amino acids 1267-1305 (DVNECLSN-PCDARGTQNCVQRVNDFHCECRAGHTGRRCE; (SEQ ID NO: 18) of the amino acid sequence depicted in FIG. 2A, or a corresponding segment of another Notch receptor polypeptide, where examples of corresponding segments are depicted in FIGS. 2B-2G; and can have a length of from 35 amino acids to about 40 amino acids (aa) (e.g., 35, 36, 37, 38, 39, or 40 aa).

An EGF repeat can comprise an amino acid sequence having at least 75%, at least 80%, at least 85%, at least 90%, at least 95%, at least 98%, at least 99%, or 100%, amino acid sequence identity to the following sequence: PCVGSN-PCYNQGTCEPTSENPFYRCLCPAKFNGLLCH (SEQ ID NO:8); and can have a length of 35 amino acids to 40 amino acids (e.g., 35, 36, 37, 38, 39, or 40 amino acids.

An LNR segment can comprise an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and can have a length of from 90 amino acids to 150 amino acids, e.g., from 90 amino acids (aa) to 100 aa, from 100 aa to 110 aa, from 110 aa to 120 aa, from 120 aa to 130 aa, from 130 aa to 140 aa, or from 140 aa to 150 aa. In some cases, an LNR segment comprises an amino acid sequence having at least 75%, at least 80%, at least 85%, at least 90%, at least 95%, at least 98%, at least 99%, or 100%, amino acid sequence identity to amino acids 1442-1562 of the amino acid sequence depicted in FIG. 2A, or a corresponding segment of another Notch receptor polypeptide, where examples of corresponding segments are depicted in FIGS. 2B-2G; and has a length of from 115 aa to 125 aa, e.g., 115, 116, 117, 118, 119, 120, 121, 122, 123, 124, or 125 aa.

An LNR segment can comprise an amino acid sequence having at least 75%, at least 80%, at least 85%, at least 90%, at least 95%, at least 98%, at least 99%, or 100%, amino acid sequence identity to the following amino acid sequence: PPQIEEACELPECQVDAGNKVCNLQCNNHACGWDG-GDCSLNFNDPWKNCTQSLQCWK YFSDGHCDSQCN-SAGCLFDGFDCQLTEGQCNPLYDQYCKDHFSDGH-CDQGCNSAECE WDGLDC (SEQ ID NO:5); and can have a length of from 118 to 122 amino acids (e.g., 118, 119, 120, 121, or 122 amino acids).

An HD-N segment can comprise an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and can have a length of from 90 amino acids (aa) to 110 aa, e.g., 90 aa to 95 aa, 95 aa to 100 aa, 100 aa to 105 aa, or 105 aa to 110 aa. In some cases, an HD-N segment comprises an amino acid sequence having at least 75%, at least 80%, at least 85%, at least 90%, at least 95%, at least 98%, at least 99%, or 100%, amino acid sequence identity to amino acids 1563-1664 of the amino acid sequence depicted in FIG. 2A, or a corresponding segment of another Notch receptor polypeptide, where examples of corresponding segments are depicted in FIGS. 2B-2G; and has a length of from 95 aa to 105 aa, e.g., 95, 96, 98, 98, 99, 100, 101, 102, 103, 104, or 105 aa.

An HD-C segment can comprise an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and can have a length of from 60 amino acids (aa) to 80 aa, e.g., from 60 aa to 65 aa, from 65 aa to 70 aa, from 70 aa to 75 aa, or from 75 aa to 80 aa. In some cases, an HD-C segment comprises an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and has a length of from 65 amino acids to 75 amino acids, e.g., 65, 66, 67, 68, 69, 70, 71, 72, 73, 74, or 75 amino acids.

An HD segment (HD-N plus HD-C) can comprise an amino acid sequence having at least 75%, at least 80%, at least 85%, at least 90%, at least 95%, at least 98%, at least 99%, or 100%, amino acid sequence identity to the following amino acid sequence: AAGTLVLVVLLPPDQLRNNS-FHFLRELSHVLHTNVVFKRDAQGQQMIF-PYYGHEEELR KHPIKRSTVGWATSSLLPGTSGGRQRRELDPMDIRG-SIVYLEIDNRQCVQSSSQCFQSAT DVAAFL- GALASLGSLNIPYKIEAVKSEPVEPPLP (SEQ ID NO:6); and can have a length of 150, 151, 152, 153, or 154 amino acids.

A transmembrane segment can comprise an amino acid sequence having at least 75%, at least 80%, at least 85%, at least 90%, at least 95%, at least 98%, at least 99%, or 100%, amino acid sequence identity to amino acids 1736 to 1756 of the amino acid sequence depicted in FIG. 2A, or a corresponding segment of another Notch receptor polypeptide, where examples of corresponding segments are depicted in FIGS. 2B-2G; and can have a length of from 15 amino acids (aa) to 25 amino acids, e.g., 15, 16, 17, 18, 29, 20, 21, 22, 23, 24, or 25 amino acids.

A transmembrane segment can comprise an amino acid sequence having at least 75%, at least 80%, at least 85%, at least 90%, at least 95%, at least 98%, at least 99%, or 100%, amino acid sequence identity to the following amino acid sequence: HLMYVAAAAFVLLFFVGCGVLLS (SEQ ID NO:7); and can have a length of 21, 22, 23, 24, or 25 amino acids.

In some cases, a Notch receptor polypeptide has a length of from about 490 amino acids (aa) to about 900 aa, and comprises an amino acid sequence having at least 75%, at least 80%, at least 85%, at least 90%, at least 95%, at least 98%, at least 99%, or 100%, amino acid sequence identity to: i) amino acids 1267-1756; ii) 1238-1756; iii) 1184-1756; iv) 1146-1756; v) 1064-1756; vi) 1021-1756; vii) 988-1756; viii) 945-1756; ix) 907-1756; or x) 869-1756, of the amino acid sequence depicted in FIG. 2A, or a corresponding segment of another Notch receptor polypeptide, where examples of corresponding segments are depicted in FIGS. 2B-2G.

Figure 4E:
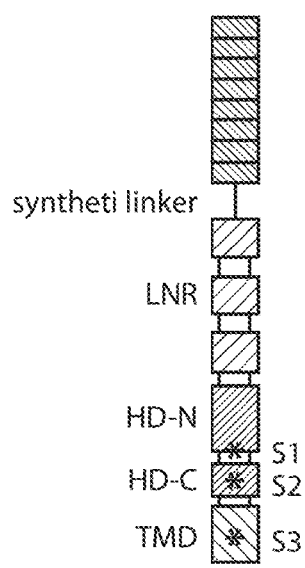

In some cases, a Notch receptor polypeptide comprises a synthetic linker. For example, in some cases, a Notch receptor polypeptide comprises, in order from N-terminus to C-terminus: i) two to eleven EGF repeats; ii) a synthetic linker; iii) an LNR segment; iv) an HD-N segment, v) an HD-C segment; and vi) a TM domain. Such a Notch receptor polypeptide is depicted schematically in FIG. 4E.

A synthetic linker can have a length of from about 10 amino acids (aa) to about 200 aa, e.g., from 10 aa to 25 aa, from 25 aa to 50 aa, from 50 aa to 75 aa, from 75 aa to 100 aa, from 100 aa to 125 aa, from 125 aa to 150 aa, from 150 aa to 175 aa, or from 175 aa to 200 aa. A synthetic linker can have a length of from 10 aa to 30 aa, e.g., 10, 11, 12, 13, 14, 15, 16, 17, 18, 19, 20, 21, 22, 23, 24, 25, 26, 27, 28, 29, or 30 aa. A synthetic linker can have a length of from 30 aa to 50 aa, e.g., from 30 aa to 35 aa, from 35 aa to 40 aa, from 40 aa to 45 aa, or from 45 aa to 50 aa.

Notch Receptor Polypeptide Comprising an HD-C Segment and a TM Domain

Figure 4F:
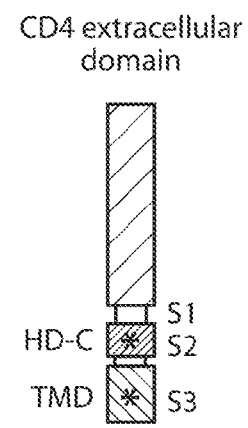

In some cases, a Notch receptor polypeptide comprises, in order from N-terminus to C-terminus: i) an HD-C segment; and ii) a TM domain, where the Notch receptor polypeptide does not include an LNR segment. In some cases, the LNR segment is replaced with a heterologous polypeptide. Such a Notch receptor polypeptide is depicted schematically in FIG. 4F.

An HD-C segment can comprise an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and can have a length of from 60 amino acids (aa) to 80 aa, e.g., from 60 aa to 65 aa, from 65 aa to 70 aa, from 70 aa to 75 aa, or from 75 aa to 80 aa. In some cases, an HD-C segment comprises an amino acid sequence having at least 75%, at least 80%, at least 85%, at least 90%, at least 95%, at least 98%, at least 99%, or 100%, amino acid sequence identity to amino acids 1665-1733 of the amino acid sequence depicted in FIG. 2A, or a corresponding segment of another Notch receptor polypeptide, where examples of corresponding segments are depicted in FIGS. 2B-2G; and has a length of from 65 amino acids to 75 amino acids, e.g., 65, 66, 67, 68, 69, 70, 71, 72, 73, 74, or 75 amino acids.

A transmembrane segment can comprise an amino acid sequence having at least 75%, at least 80%, at least 85%, at least 90%, at least 95%, at least 98%, at least 99%, or 100%, amino acid sequence identity to amino acids 1736 to 1756 of the amino acid sequence depicted in FIG. 2A, or a corresponding segment of another Notch receptor polypeptide, where examples of corresponding segments are depicted in FIGS. 2B-2G; and can have a length of from 15 amino acids (aa) to 25 amino acids, e.g., 15, 16, 17, 18, 29, 20, 21, 22, 23, 24, or 25 amino acids.

A transmembrane segment can comprise an amino acid sequence having at least 75%, at least 80%, at least 85%, at least 90%, at least 95%, at least 98%, at least 99%, or 100%, amino acid sequence identity to the following amino acid sequence: HLMYVAAAAFVLLFFVGCGVLLS (SEQ ID NO:7); and can have a length of 21, 22, 23, 24, or 25 amino acids.

In some cases, a Notch receptor polypeptide comprises an amino acid sequence having at least 75%, at least 80%, at least 85%, at least 90%, at least 95%, at least 98%, at least 99%, or 100%, amino acid sequence identity to amino acids 1665 to 1756 of the amino acid sequence depicted in FIG. 2A, or a corresponding segment of another Notch receptor polypeptide, where examples of corresponding segments are depicted in FIGS. 2B-2G; and has a length of from 85 amino acids (aa) to 95 aa (e.g., 85, 86, 87, 88, 89, 90, 91, 92, 93, 94, or 95 aa).

In some cases, a Notch receptor polypeptide comprises an amino acid sequence having at least 75%, at least 80%, at least 85%, at least 90%, at least 95%, at least 98%, at least 99%, or 100%, amino acid sequence identity to amino acids 1665 to 1756 of the amino acid sequence depicted in FIG. 2A, or a corresponding segment of another Notch receptor polypeptide, where examples of corresponding segments are depicted in FIGS. 2B-2G; and comprises a heterologous polypeptide fused in-frame at the N-terminus of the Notch receptor polypeptide.

Ligand-Inducible Proteolytic Cleavage Sites

As noted above, a chimeric Notch receptor polypeptide of the present disclosure comprises a Notch receptor polypeptide having a length of from 50 amino acids to 1000 amino acids, and comprising one or more ligand-inducible proteolytic cleavage sites. As discussed above, a chimeric Notch receptor polypeptide of the present disclosure comprises: a) an extracellular domain comprising a first member of a specific binding pair; b) a Notch receptor polypeptide having a length of from 50 amino acids to 1000 amino acids, and comprising one or more ligand-inducible proteolytic cleavage sites; and c) an intracellular domain, where binding of the first member of the specific binding pair to a second member of a specific binding pair induces cleavage of the Notch receptor polypeptide at the one or more ligand-inducible proteolytic cleavage sites, thereby releasing the intracellular domain. The second member ("ligand") of the specific binding pair can be present on a contacting (e.g., "sending") cell.

In some cases, the Notch receptor polypeptide includes only one ligand-inducible proteolytic cleavage site. In some cases, the Notch receptor polypeptide includes two ligand-inducible proteolytic cleavage sites. In some cases, the Notch receptor polypeptide includes three ligand-inducible proteolytic cleavage sites. For simplicity, ligand-inducible cleavage sites will be referred to herein as "S1," "S2," and "S3" ligand-inducible proteolytic cleavage sites.

In some cases, the Notch receptor polypeptide includes an S1 ligand-inducible proteolytic cleavage site. An S1 ligand-inducible proteolytic cleavage site can be located between the HD-N segment and the HD-C segment. In some cases, the S1 ligand-inducible proteolytic cleavage site is a furin-like protease cleavage site. A furin-like protease cleavage site can have the canonical sequence Arg-X-(Arg/Lys)-Arg, where X is any amino acid; the protease cleaves immediately C-terminal to the canonical sequence. For example, in some cases, an amino acid sequence comprising an S1 ligand-inducible proteolytic cleavage site can have the amino acid sequence GRRRRELDPM (SEQ ID NO:19), where cleavage occurs between the "RE" sequence. As another example, an amino acid sequence comprising an S1 ligand-inducible proteolytic cleavage site can have the amino acid sequence RQRRELDPM (SEQ ID NO:20), where cleavage occurs between the "RE" sequence.

In some cases, the Notch receptor polypeptide includes an S2 ligand-inducible proteolytic cleavage site. An S2 ligand-inducible proteolytic cleavage site can be located within the HD-C segment. In some cases, the S2 ligand-inducible proteolytic cleavage site is an ADAM-17-type protease cleavage site. An ADAM-17-type protease cleavage site can comprise an Ala-Val dipeptide sequence, where the enzyme cleaves between the Ala and the Val. For example, in some cases, amino acid sequence comprising an S2 ligand-inducible proteolytic cleavage site can have the amino acid sequence KIEAVKSE (SEQ ID NO:21), where cleavage occurs between the "AV" sequence. As another example, an amino acid sequence comprising an S2 ligand-inducible proteolytic cleavage site can have the amino acid sequence KIEAVQSE (SEQ ID NO:22), where cleavage occurs between the "AV" sequence.

In some cases, the Notch receptor polypeptide includes an S3 ligand-inducible proteolytic cleavage site. An S3 ligand-inducible proteolytic cleavage site can be located within the TM domain. In some cases, the S3 ligand-inducible proteolytic cleavage site is a gamma-secretase (γ-secretase) cleavage site. A γ-secretase cleavage site can comprise a Gly-Val dipeptide sequence, where the enzyme cleaves between the Gly and the Val. For example, in some cases, an S3 ligand-inducible proteolytic cleavage site has the amino acid sequence VGCGVLLS (SEQ ID NO:23), where cleavage occurs between the "GV" sequence. In some cases, an S3 ligand-inducible proteolytic cleavage site comprises the amino acid sequence GCGVLLS (SEQ ID NO:24).

Figure 4G:
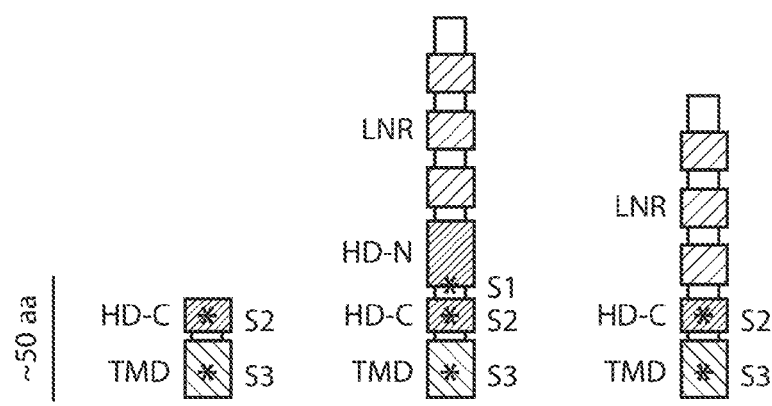

In some cases, the Notch receptor polypeptide lacks an S1 ligand-inducible proteolytic cleavage site. In some cases, the Notch receptor polypeptide lacks an S2 ligand-inducible proteolytic cleavage site. In some cases, the Notch receptor polypeptide lacks an S3 ligand-inducible proteolytic cleavage site. In some cases, the Notch receptor polypeptide lacks both an S1 ligand-inducible proteolytic cleavage site and an S2 ligand-inducible proteolytic cleavage site. In some cases, the Notch receptor polypeptide includes an S3 ligand-inducible proteolytic cleavage site; and lacks both an S1 ligand-inducible proteolytic cleavage site and an S2 ligand-inducible proteolytic cleavage site. Examples are depicted schematically in FIG. 4G.

Intracellular Domain

As noted above, a chimeric Notch receptor polypeptide of the present disclosure comprises an intracellular domain that is released following binding of the chimeric Notch receptor polypeptide to the second member of the specific binding pair, where binding of the chimeric Notch receptor polypeptide to the second member of the specific binding pair induces cleavage of an above-mentioned proteolytic cleavage site.

The intracellular domain comprises an amino acid sequence that is heterologous to the Notch receptor polypeptide. In other words, the intracellular domain comprises an amino acid sequence that is not naturally present in a Notch receptor polypeptide.

The intracellular domain, when released from the chimeric Notch receptor polypeptide, provides an effector function, where effector functions include, e.g., increased production of one or more cytokines by the cell; reduced production of one or more cytokines by the cell; increased or decreased production of a hormone by the cell; production of an antibody by the cell; a change in organelle activity; a change in trafficking of a polypeptide within the cell; a change in transcription of a target gene; a change in activity of a protein; a change in cell behavior, e.g., cell death; cellular proliferation; effects on cellular differentiation; effects on cell survival; modulation of cellular signaling responses; etc. In some cases, the intracellular domain, when released from the chimeric Notch receptor polypeptide, provides for a change in transcription of a target gene. In some cases, the intracellular domain, when released from the chimeric Notch receptor polypeptide, provides for an increase in the transcription of a target gene. In some cases, the intracellular domain, when released from the chimeric Notch receptor polypeptide, provides for a decrease in a target gene.

The intracellular domain can be any of a wide variety of polypeptides, where examples include, but are not limited to, transcriptional activators; transcriptional repressors; transcriptional co-activators; transcriptional co-repressors; DNA binding polypeptides; RNA binding polypeptides; translational regulatory polypeptides; hormones; cytokines; toxins; antibodies; chromatin modulators; suicide proteins; organelle specific polypeptides (e.g., a nuclear pore regulator, a mitochondrial regulator, an endoplasmic reticulum regulator, and the like); pro-apoptosis polypeptides; anti-apoptosis polypeptides; other polypeptides that promote cell death through other mechanisms; pro-proliferation polypeptides; anti-proliferative polypeptides; immune co-stimulatory polypeptides; site-specific nucleases; recombinases; inhibitory immunoreceptors; an activating immunoreceptor; Cas9 and variants of RNA targeted nucleases; and DNA recognition polypeptides; dominant negative variants of a polypeptide; a signaling polypeptide; a receptor tyrosine kinase; a non-receptor tyrosine kinase; a polypeptide that promotes differentiation; and the like.

In some cases, the intracellular domain comprises a signaling polypeptide. Suitable signaling polypeptides include, e.g., STAT3/5, Akt, Myc, and the like. In some cases, the signaling polypeptide is a part of a PI3K/mTOR-, NFκB-, MAPK-, STAT-, FAK-, MYC, or TGF-β mediated signaling pathway. In some cases, the signaling polypeptide is a part of a Ras/Raf/Mek/Erk1/2, a JAK/STAT3, or a PI3K/Akt signaling pathway.

In some cases, the intracellular domain comprises dominant negative variant of a polypeptide, e.g., a dominant negative variant of a signaling polypeptide. Examples of dominant negative variants include, e.g., a dominant negative TGF-β receptor; a dominant negative variant of STAT3 comprising one or more mutations affecting the DNA binding domain of STAT3 that functions as a dominant negative variant; and the like.

In some cases, the intracellular domain is an antibody-based scaffold or a non-antibody-based scaffold that blocks or alters a cellular activity when released from the chimeric Notch receptor polypeptide.

In some cases, the intracellular domain comprises an immunoreceptor, e.g., an activating immunoreceptor or an inhibitory immunoreceptor. A suitable activating immunoreceptor can comprise an immunoreceptor tyrosine-based activation motif (ITAM). An ITAM motif is $YX_1X_2L/I$, where $X_1$ and $X_2$ are independently any amino acid. A suitable intracellular signaling domain can be an ITAM motif-containing portion that is derived from a polypeptide that contains an ITAM motif. For example, a suitable intracellular signaling domain can be an ITAM motif-containing domain from any ITAM motif-containing protein. Thus, a suitable intracellular signaling domain need not contain the entire sequence of the entire protein from which it is derived. Examples of suitable ITAM motif-containing polypeptides include, but are not limited to: DAP12; FCER1G (Fc epsilon receptor I gamma chain); CD3D (CD3 delta); CD3E (CD3 epsilon); CD3G (CD3 gamma); CD3Z (CD3 zeta); and CD79A (antigen receptor complex-associated protein alpha chain). As one non-limiting example, a suitable ITAM motif-containing polypeptide can comprise an amino acid sequence having at least about 75%, at least about 80%, at least about 85%, at least about 90%, at least about 95%, at least about 98%, or 100%, amino acid sequence identity to the following amino acid sequence: ESPYQELQGQRSDVYSDLNTQ (SEQ ID NO:25), where the ITAM motifs are in bold and are underlined. As another example, a suitable ITAM motif-containing polypeptide can comprise an amino acid sequence having at least about 75%, at least about 80%, at least about 85%, at least about 90%, at least about 95%, at least about 98%, or 100%, amino acid sequence identity to the following amino acid sequence: DGVYTGLSTRNQETYETLKHE (SEQ ID NO:26), where the ITAM motifs are in bold and are underlined. The polypeptide can comprise an ITAM motif-containing portion of the full length CD3 zeta amino acid sequence. As another example, a suitable ITAM motif-containing polypeptide can comprise an amino acid sequence having at least about 75%, at least about 80%, at least about 85%, at least about 90%, at least about 95%, at least about 98%, or 100%, amino acid sequence identity to any of the following amino acid sequences: RVKFSRSADAPAYQQGQNQLYNELNLGRREEYDVLDKRRGRDPEMGGKPRRKNPQEG L YNELQKDKMAEAYSEIGMKGERRRGKGHDGLYQGLSTATKDTYDALHMQALPPR (SEQ ID NO:27); NQLYNELNLGRREEYDVLDKR (SEQ ID NO:28); EGLYNELQKDKMAEAYSEIGMK (SEQ ID NO: 29); or DGLYQGLSTATKDTYDALHMQ (SEQ ID NO:30), where the ITAM motifs are in bold and are underlined.

Intracellular signaling domains suitable for use in a chimeric Notch polypeptide of the present disclosure include immunoreceptor tyrosine-based activation motif (ITAM)-containing intracellular signaling polypeptides. An ITAM motif is $YX_1X_2L/I$, where $X_1$ and $X_2$ are independently any amino acid. In some cases, the intracellular signaling domain of a chimeric Notch polypeptide comprises 1, 2, 3, 4, or 5 ITAM motifs. In some cases, an ITAM motif is repeated twice in an intracellular signaling domain, where the first and second instances of the ITAM motif are separated from one another by 6 to 8 amino acids, e.g., $(YX_1X_2L/I)(X_3)_n(YX_1X_2L/I)$, where n is an integer from 6 to 8, and each of the 6-8 $X_3$ can be any amino acid. In some cases, the intracellular signaling domain of a chimeric Notch polypeptide comprises 3 ITAM motifs.

A suitable intracellular signaling domain can be an ITAM motif-containing portion that is derived from a polypeptide that contains an ITAM motif. For example, a suitable intracellular signaling domain can be an ITAM motif-containing domain from any ITAM motif-containing protein. Thus, a suitable intracellular signaling domain need not contain the entire sequence of the entire protein from which it is derived. Examples of suitable ITAM motif-containing polypeptides include, but are not limited to: DAP12; FCER1G (Fc epsilon receptor 1 gamma chain); CD3D (CD3 delta); CD3E (CD3 epsilon); CD3G (CD3 gamma); CD3Z (CD3 zeta); and CD79A (antigen receptor complex-associated protein alpha chain).

In some cases, the intracellular signaling domain is derived from DAP12 (also known as TYROBP; TYRO protein tyrosine kinase binding protein; KARAP; PLOSL; DNAX-activation protein 12; KAR-associated protein; TYRO protein tyrosine kinase-binding protein; killer activating receptor associated protein; killer-activating receptor-associated protein; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to any of the following amino acid sequences (4 isoforms): MGGLEPCSRLLLLPLLLAVSGLRPVQAQAQSDCSCSTVSPGVLAGIVMGDLVLTVLIAL AVYFLGRLVPRGRGAAEAATRKQRITETESPYQELQGQRSDVYSDLNTQRPYYK (SEQ ID NO:31); MGGLEPCSRLLLLPLLLAVSGLRPVQAQAQSDCSCSTVSPGVLAGIVMGDLVLTVLIAL AVYFLGRLVPRGRGAAEATRKQRITETESPYQELQGQRSDVYSDLNTQRPYYK (SEQ ID NO:32); MGGLEPCSRLLLLPLLLAVSDCSCSTVSPGVLAGIVMGDLVLTVLIALAVYFLGRLVPRG RGAAEAATRKQRITETESPYQELQGQRSDVYSDLNTQRPYYK (SEQ ID NO:33); or MGGLEPCSRLLLLPLLLAVSDCSCSTVSPGVLAGIVMGDLVLTVLIALAVYFLGRLVPRG RGAAEATRKQRITETESPYQELQGQRSDVYSDLNTQRPYYK (SEQ ID NO:34), where the ITAM motifs are in bold and are underlined.

Likewise, a suitable intracellular signaling domain polypeptide can comprise an ITAM motif-containing portion of the full length DAP12 amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: ESPYQELQGQRSDVYSDLNTQ (SEQ ID NO:25), where the ITAM motifs are in bold and are underlined.

In some cases, the intracellular signaling domain is derived from FCER1G (also known as FCRG; Fc epsilon receptor I gamma chain; Fc receptor gamma-chain; fc-epsilon RI-gamma; fcRgamma; fceRI gamma; high affinity immunoglobulin epsilon receptor subunit gamma; immunoglobulin E receptor, high affinity, gamma chain; etc.). For example, a suitable intracellular signaling domain polypeptide can comprise an amino acid sequence having at least about 75%, at least about 80%, at least about 85%, at least about 90%, at least about 95%, at least about 98%, or 100% amino acid sequence identity to the following amino acid sequence: MIPAVVLLLLLLVEQAAALGEPQLCYILDAI- LFLYGIVLTLLYCRLKIQVRKAAITSYEKS DGV YTGL STRNQET YETL KHEKPPQ (SEQ ID NO:35), where the ITAM motifs are in bold and are underlined.

Likewise, a suitable intracellular signaling domain polypeptide can comprise an ITAM motif-containing portion of the full length FCER1G amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DGV YTGL STRNQET YETL KHE (SEQ ID NO:26), where the ITAM motifs are in bold and are underlined.

In some cases, the intracellular signaling domain is derived from T-cell surface glycoprotein CD3 delta chain (also known as CD3D; CD3-DELTA; T3D; CD3 antigen, delta subunit; CD3 delta; CD3d antigen, delta polypeptide (TiT3 complex); OKT3, delta chain; T-cell receptor T3 delta chain; T-cell surface glycoprotein CD3 delta chain; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 170 aa, of either of the following amino acid sequences (2 isoforms): MEHSTFLSGLVLATLLSQVSPFKIPIEELEDRVFVNCNTSITWVEGTVGTLLSDITRLDLG KRILDPRGIYRCNGTDIYKDKESTVQVHYRMCQSCVELDPATVAGIIVTDVIATL LLALG VFCFAGHETGRLSGAADTQALLRNDQV YQPLRDRDDAQYSHL GGNWARNK (SEQ ID NO:36) or MEHSTFLSGLVLATLLSQVSPFKIPIEELEDRVFVNCNTSITWVEGTVGTLLSDITRLDLG KRILDPRGIYRCNGTDIYKDKESTVQVHYRTADTQALLRNDQV YQPLRDRDDAQYSHL GGNWARNK (SEQ ID NO:37), where the ITAM motifs are in bold and are underlined.

Likewise, a suitable intracellular signaling domain polypeptide can comprise an ITAM motif-containing portion of the full length CD3 delta amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DQV YQPLRDRDDAQYSHL GGN (SEQ ID NO:38), where the ITAM motifs are in bold and are underlined.

In some cases, the intracellular signaling domain is derived from T-cell surface glycoprotein CD3 epsilon chain (also known as CD3e, T-cell surface antigen T3/Leu-4 epsilon chain, T-cell surface glycoprotein CD3 epsilon chain, AI504783, CD3, CD3epsilon, T3e, etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 205 aa, of the following amino acid sequence: MQSGTHWRVLGLCLLSVGVWGQDGNEEMGGITQTPYKVSISGTT-VILTCPQYPGSEILW QHNDKNIGGDEDDKNIGSDED-HLSLKEFSELEQSGYYVCYPRGSKPEDANFYLYL RARV CENCMEMDVMSVATIVIVDICITGGLLLLVYY-WSKNRKAKAKPVTRGAGAGGRQRGQ NKERPPPVP-NPD YEPIRKGQRDL YSGL NQRRI (SEQ ID NO:39), where the ITAM motifs are in bold and are underlined.

Likewise, a suitable intracellular signaling domain polypeptide can comprise an ITAM motif-containing portion of the full length CD3 epsilon amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: NPD YEPIRKGQRDL YSGL NQR (SEQ ID NO:40), where the ITAM motifs are in bold and are underlined.

In some cases, the intracellular signaling domain is derived from T-cell surface glycoprotein CD3 gamma chain (also known as CD3G, T-cell receptor T3 gamma chain, CD3-GAMMA, T3G, gamma polypeptide (TiT3 complex), etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 180 aa, of the following amino acid sequence: MEQGKGLAVLILAIILLQGT-LAQSIKGNHLVKVYDYQEDGSVLLTCDAEAKNIT-WFKDG KMIGFLTEDKKKWNLGSNAKDPRGMY-QCKGSQNKSKPLQVYYRMCQNCIELNAATIS GFLFAEIVSIFVLAVGVYFIAGQDGVRQSRASD-KQTLLPNDQL YQPLKDREDDQ YSHLQ GNQLRRN (SEQ ID NO:41), where the ITAM motifs are in bold and are underlined.

Likewise, a suitable intracellular signaling domain polypeptide can comprise an ITAM motif-containing portion of the full length CD3 gamma amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DQL YQPLKDREDDQ YSHL QGN (SEQ ID NO:42), where the ITAM motifs are in bold and are underlined.

In some cases, the intracellular signaling domain is derived from T-cell surface glycoprotein CD3 zeta chain (also known as CD3Z, T-cell receptor T3 zeta chain, CD247, CD3-ZETA, CD3H, CD3Q, T3Z, TCRZ, etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 160 aa, of either of the following amino acid sequences (2 isoforms): MKWKALFTAAILQAQL-PITEAQSFGLLDPKLCYLLDGILFIYGVILTALFL-RVKFSRSADA PAYQQGQNQL YNEL NLGRREE YDVLDKRRGRDPEMGGKPRRKNPQEGL YNEL QKDK MAEA YSEI GMKGERRRGKGHDGL YQGL STATKDT YDALHMQALPPR (SEQ ID NO:43) or MKWKA-
LFTAAILQAQLPITEAQSFGLLDPKLCYLLLDGILFI-
YGVILTALFLRVKFSRSADA PAYQQGQNQL
YNELNLGRREE
YDVLDKRRGRDPEMGGKPQRRKNPQEGLYNELQKD
KMAEAYSEIGMKGERRRGKGHDGLYQGLSTATKDT
YDALHMQALPPR(SEQ ID NO:44), where the ITAM
motifs are in bold and are underlined.

Likewise, a suitable intracellular signaling domain polypeptide can comprise an ITAM motif-containing portion of the full length CD3 zeta amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to any of the following amino acid sequences: RVKFSRSADAPAYQQGQNQL
YNELNLGRREE
YDVLDKRRGRDPEMGGKPRRKNPQEG L
YNELQKDKMAEAYSEIGMKGERRRGKGHDGL
YQGLSTATKDTYDALHMQALPPR (SEQ ID NO:27);
NQLYNELNLGRREEYDVLDKR (SEQ ID NO:28); EGL
YNELQKDKMAEAYSEIGMK (SEQ ID NO:29); or DGL
YQGLSTATKDTYDALHMQ (SEQ ID NO:30), where the ITAM motifs are in bold and are underlined.

In some cases, the intracellular signaling domain is derived from CD79A (also known as B-cell antigen receptor complex-associated protein alpha chain; CD79a antigen (immunoglobulin-associated alpha); MB-1 membrane glycoprotein; ig-alpha; membrane-bound immunoglobulin-associated protein; surface IgM-associated protein; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 150 aa, from about 150 aa to about 200 aa, or from about 200 aa to about 220 aa, of either of the following amino acid sequences (2 isoforms):
MPGGPGVLQALPATIFLLFLLSAVYLGPGCQAL-
WMHKVPASLMVSLGEDAHFQ CPHNSSNNANVTW-
WRVLHGNYTWPPEFLGPGEDPNGTLIIQNVNKSHG-
GIYVCRVQEG
NESYQQSCGTYLRVRQPPPRPFLDMGEGTKNRIITAE-
GIILLFCAVVPGTLLLFRKRWQN EKL-
GLDAGDEYEDENLYEGLNLDDCSM
YEDISRGLQGTYQDVGSLNIGDVQLEKP (SEQ ID
NO:45); or
MPGGPGVLQALPATIFLLFLLSAVYLGPGCQAL-
WMHKVPASLMVSLGEDAHFQ CPHNSSNNANVTW-
WRVLHGNYTWPPEFLGPGEDPNEPPPRPFLDMGEGT-
KNRIITAEGII
LLFCAVVPGTLLLFRKRWQNEKLGLDAGDEYEDEN-
LYEGLNLDDCSMYEDISRGLQGT YQDVGSLNIGD-
VQLEKP (SEQ ID NO:46), where the ITAM motifs are in bold and are underlined.

Likewise, a suitable intracellular signaling domain polypeptide can comprise an ITAM motif-containing portion of the full length CD79A amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: ENLYEGLNLDDCSMYEDISRG (SEQ ID NO:47), where the ITAM motifs are in bold and are underlined.

DAP10/CD28

Intracellular signaling domains suitable for use in a chimeric Notch polypeptide of the present disclosure include a DAP10/CD28 type signaling chain.

An example of a DAP10 signaling chain is the amino acid sequence is: RPRRSPAQDGKVYINMPGRG (SEQ ID NO:48). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence RPRRSPAQDGKVYINMPGRG (SEQ ID NO:48).

An example of a CD28 signaling chain is the amino acid sequence is FWVLVVVGGVLACYSLLVTVAFIIFWVR-
SKRSRLLHSDYMNMTPRRPGPTRKHYQPYA PPRD-
FAAYRS (SEQ ID NO:49). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence FWVLVVVGGVLACYSLLVTVAFI-
IFWVRSKRSRLLHSDYMNMTPRRPGPTRKHYQPYA
PPRDFAAYRS (SEQ ID NO:49).

ZAP70

Intracellular signaling domains suitable for use in a chimeric Notch polypeptide of the present disclosure include a ZAP70 polypeptide, e.g., a polypeptide comprising an amino acid sequence having at least about 85%, at least about 90%, at least about 95%, at least about 98%, at least about 99%, or 100%, amino acid sequence identity to a contiguous stretch of from about 300 amino acids to about 400 amino acids, from about 400 amino acids to about 500 amino acids, or from about 500 amino acids to 619 amino acids, of the following amino acid sequence: MPDPAAHL-
PFFYGSISRAEAEEHLKLAGMADGLFLLRQCLRSLG-
GYVLSLVHDVRFHHF PIERQLNGTYAIAGGKAHCG-
PAELCEFYSRDPDGLPCNLRKPCNRPSGLEPQPGV
DCLR DAMVRDYVRQTWKLEGEALEQAI-
ISQAPQVEKLIATTAHERMPWYHSSLTREEAERKL
YSGAQTDGKFLLRPRKEQGTYALSLIYGKTVY-
HYLISQDKAGKYCIPEGTKFDTLWQLV
EYLKLKADGLIYCLKEACPNSSASNAS-
GAAAPTLPAHPSTLTHPQRRIDTLNSDGYTPEP
ARITSPDKPRPMPMDTSVYESPYSDPEELKDKKL-
FLKRDNLLIADIELGCGNFGSVRQGV YRMRKKQID-
VAIKVLKQGTEKADTEEMMREAQIMHQLDNPYIVR-
LIGVCQAEALMLV
MEMAGGGPLHKFLVGKREEIPVSNVAELLHQVSMG-
MKYLEEKNFVHRDLAARNVLLV NRHYAKISDFGL-
SKALGADDSYYTARSAGKWPLKWYAPECINFRKF-
SSRSDVWSYGVT
MWEALSYGQKPYKKMKGPEVMAFIEQG-
KRMECPPECPPELYALMSDCWIYKWEDRPD FLT-
VEQRMRACYYSLASKVEGPPGSTQKAEAACA (SEQ
ID NO:50).

Co-stimulatory domains derived from receptors are suitable for use as the intracellular domain of a chimeric Notch polypeptide of the present disclosure. The co-stimulatory domain can be an intracellular portion of a transmembrane protein (i.e., the co-stimulatory domain can be derived from a transmembrane protein). Non-limiting examples of suitable co-stimulatory polypeptides include, but are not limited to, 4-1BB (CD137), CD28, ICOS, OX-40, BTLA, CD27, CD30, GITR, and HVEM.

In some cases, the co-stimulatory domain is derived from an intracellular portion of the transmembrane protein CD28 (also known as Tp44). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: FWVRSKRSRLLHSDYMNMTPRRPGPTRKHYQPYAPPRDFAAYRS (SEQ ID NO:51).

In some cases, the co-stimulatory domain is derived from an intracellular portion of the transmembrane protein 4-1BB (also known as TNFRSF9; CD137; 4-1BB; CDw137; ILA; etc.). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: KRGRKKLLYIFKQPFMRPVQTTQEEDGCSCRFPEEEEGGCEL (SEQ ID NO:52).

In some cases, the co-stimulatory domain is derived from an intracellular portion of the transmembrane protein OX-40 (also known as TNFRSF4, RP5-902P8.3, ACT35, CD134, OX40, TXGP1L). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: RRDQRLPPDAHKPPGGGSFRTPIQEEQADAHSTLAKI (SEQ ID NO:53).

In some cases, the co-stimulatory domain is derived from an intracellular portion of the transmembrane protein BTLA (also known as BTLA1 and CD272). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: CCLRRHQGKQNELSDTAGREINLVDAHLKSEQTEASTRQNSQVLLSETGIYDNDPDLCF RMQEGSEVYSNPCLEENKPGIVYASLNHSVIGPNSRLARNVKEAPTEYASICVRS (SEQ ID NO:54).

In some cases, the co-stimulatory domain is derived from an intracellular portion of the transmembrane protein CD27 (also known as 5152, T14, TNFRSF7, and Tp55). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HQRRKYRSNKGESPVEPAEPCRYSCPREEEGSTIPIQEDYRKPEPACSP (SEQ ID NO:55).

In some cases, the co-stimulatory domain is derived from an intracellular portion of the transmembrane protein CD30 (also known as TNFRSF8, D1S166E, and Ki-1). For example, a suitable co-stimulatory domain can comprise an amino acid sequence having at least about 75%, at least about 80%, at least about 85%, at least about 90%, at least about 95%, at least about 98%, or 100% amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, from about 150 aa to about 160 aa, or from about 160 aa to about 185 aa of the following amino acid sequence: RRACRKRIRQKLHLCYPVQTSQPKLELVDSRPRRSSTQLRSGASVTEPVAEERGLMSQPL METCHSVGAAYLESLPLQDASPAGGPSSPRDLPEPRVSTEHTNNKIEKIYIMKADTVIVG TVKAELPEGRGLAGPAEPELEEELEADHTPHYPEQETEPPLGSCSDVMLSVEEEGKEDPL PTAASGK (SEQ ID NO:56).

In some cases, the co-stimulatory domain is derived from an intracellular portion of the transmembrane protein GITR (also known as TNFRSF18, RP5-902P8.2, AITR, CD357, and GITR-D). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HIWQLRSQCMWPRETQLLLEVPPSTEDARSCQFPEEERGERSAEEKGRLGDLWV (SEQ ID NO:57).

In some cases, the co-stimulatory domain derived from an intracellular portion of the transmembrane protein HVEM (also known as TNFRSF14, RP3-395M20.6, ATAR, CD270, HVEA, HVEM, LIGHTR, and TR2). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: CVKRRKPRGDVVKVIVSVQRKRQEAEGEATVIEALQAPPDVTTVAVEETIPSFTGRSPN H (SEQ ID NO:58).

A suitable inhibitory immunoreceptor can comprise an immunoreceptor tyrosine-based inhibition motif (ITIM), an immunoreceptor tyrosine-based switch motif (ITSM), an NpxY motif, or a YXXΦ motif. Suitable inhibitor immunoreceptors include PD1; CTLA4; BTLA; CD160; KRLG-1; 2B4; Lag-3; and Tim-3. See, e.g., Odorizzi and Wherry (2012) *J. Immunol.* 188:2957; and Baitsch et al. (2012) *PLoSOne* 7:e30852.

In some cases, a suitable inhibitory immunoreceptor comprises an amino acid sequence having at least 75%, at least 80%, at least 85%, at least 90%, at least 95%, at least 98%, at least 99%, or 100%, amino acid sequence identity to the following PD1 amino acid sequence: MQIPQAPWPVVWAVLQLGWRPGWFLDSPDRPWNPPTFSPALLVVTEGDATFTCSFSNT SESFVLNWYRMSPSNQTDKLAAFPEDRSQPGQDCRFRVTQLPNGRDFHMSVVR ARRND SGTYLCGAISLAPKAQIKESLRAELRVTERRAEVPTAHPSPSPRPAGQFQTLV (SEQ ID NO: 59).

In some cases, a suitable inhibitory immunoreceptor comprises an amino acid sequence having at least 75%, at least 80%, at least 85%, at least 90%, at least 95%, at least 98%, at least 99%, or 100%, amino acid sequence identity to the following CTLA4 amino acid sequence: MACLGFQRHKAQLNLATRTWPCTLLFFLLFIPVFCKAMHVAQPAVVLASSRGIA SFVCEYASPGKATEVRVTVLRQADSQVTEVCAATYMMGNELTFLDDSICTGTSSGNQV NLTIQGLRAMDTGLYICKVELMYPPPYYLGIGNGTQIYVIDPEPCPDSDFLLWILAAVSS GLFFYSFLLTAVSLSKMLKKRSPLTTGVYVKMPPTEPECEKQFQPYFIPIN (SEQ ID NO:60).

In some cases, a suitable inhibitory immunoreceptor comprises an amino acid sequence having at least 75%, at least 80%, at least 85%, at least 90%, at least 95%, at least 98%, at least 99%, or 100%, amino acid sequence identity to the following CD160 amino acid sequence: MLLEPGRGCCALAILLAIVDIQSGGCINITSSASQEGTRLNLICTVWHKKEEAEGFVVFLC KDRSGDCSPETSLKQLRLKRDPGIDGVGEISSQLMFTISQVTPLHSGTYQCCARSQKSGIR

LQGHFFSILFTETGNYTVTGLKQRQHLEFSH-
NEGTLSSGFLQEKVWVMLVTSLVALQAL (SEQ ID NO:61).

In some cases, a suitable inhibitory immunoreceptor comprises an amino acid sequence having at least 75%, at least 80%, at least 85%, at least 90%, at least 95%, at least 98%, at least 99%, or 100%, amino acid sequence identity to the following T-cell immunoglobulin and mucin domain-3 (Tim-3) amino acid sequence:
MFSHLPFDCVLLLLLLLLTRSSEVEYRAEVGQNAY-LPCFYTPAAPGNLVPVCWG KGACPVFECGNVVLRT-DERDVNYWTSRYWLNGDFRKGDVSLTIENVTLADS-GIYCCRI QIPGIMNDEKFNLKLVIKPAKVTPAPTLQRDFTAAF-PRMLTTRGHGPAETQTLGSLPDIN LTQISTLANELRD-SRLANDLRDSGATIRIGIYIGAGICAGLALALIFGAL-IFKWYSHSKEKI QNLSLISLANLPPSGLANAVAEGIRSEENIYTIEEN-VYEVEEPNEYYCYVSSRQQPSQPLG CRFAMP (SEQ ID NO:62).

In some cases, a suitable inhibitory immunoreceptor comprises an amino acid sequence having at least 75%, at least 80%, at least 85%, at least 90%, at least 95%, at least 98%, at least 99%, or 100%, amino acid sequence identity to amino acids 23-525 of the following lymphocyte activation gene 3 (Lag-3) amino acid sequence: MWEAQFLGLL-FLQPLWVAPVKPLQPGAEVPVVWAQEGAPAQLPCSP-TIPLQDLSLLRR AGVTWQHQPDSGPPAAAPGHPLAPGPHPAAPSSWG-PRPRRYTVLSVGPGGLRSGRLPL QPRVQLDER-GRQRGDFSLWLRPARRADAGEYRAAVHL-RDRALSCRLRLRLGQASMTA SPPGSLRASDWVILNCSFSRPDRPASVHWFRN-RGQGRVPVRESPHHHLAESFLFLPQVSP MDSGP-WGCILTYRDGFNVSIMYNLTVLGLEPPTPLTVYA-GAGSRVGLPCRLPAGVGTRS FLTAKWTPPGGGPDLLVTGDNGDFTLRLED-VSQAQAGTYTCHIHLQEQQLNATVTLAII TVTPKSF-GSPGSLGKLLCEVTPVSGQERFVWSSLDTPSQRSF-SGPWLEAQEAQLLSQPW QCQLYQGERLLGAAVYFTELSSPGAQRSGRAPGAL-PAGHLLLFLILGVLSLLLLVTGAFG FHLWRRQWR-PRRFSALEQGIHPPQAQSKIEELEQEPEPEPEPEPEPEP-EPEPEQL (SEQ ID NO:63).

In some cases, the intracellular domain is a Siglec. See, e.g., Varki and Angata (2006) *Glycobiol.* 16:1R. In some cases, the Siglec is Siglec-15. In some cases, the intracellular domain is KIR2DL4. Miah et al. (2008) *J. Immunol.* 180: 2922.

In some cases, the intracellular domain is a recombinase. Suitable recombinases include a Cre recombinase; a Flp recombinase; a Dre recombinase; and the like. A suitable recombinase is a FLPe recombinase (see, e.g., Akbudak and Srivastava (2011) *Mol. Biotechnol.* 49:82). A suitable recombinase is a Flpo recombinase.

A recombinase, as described herein, may be an intact recombinase or a split recombinase. Portions of a split recombinase may be expressed from the same or different expression constructs. In some instances, two parts of a split recombinase may be operably linked to different binding-triggered transcriptional switches. In other instances, a first part of a split recombinase may be operably linked to a binding triggered transcriptional switch and the second part of the split recombinase may be separately expressed from an expression construct.

Where split recombinases are utilized, e.g., as in logic gated SynNotch circuits, the portions of the split recombinase may be arranged in and expressed from one or more expression cassettes with other components in various ways essentially as described below regarding split transcription factors.

Accordingly, activation of one or more binding-triggered transcriptional switches may induce expression of portions of split recombinases resulting in heterodimerization and/or complex formation of the split recombinase portions resulting in formation of a functional recombinase. Alternatively, activation of one or more binding-triggered transcriptional switches may result in release of recombinase portions from the one or more binding-triggered transcriptional switches resulting in heterodimerization and/or complex formation of the split recombinase portions resulting in formation of a functional recombinase. In addition, induction and release of split recombinase portions may be combined, e.g., where activation of one or more binding-triggered transcriptional switches may induce expression of portions of split recombinases and release of split recombinase portions from the one or more binding-triggered transcriptional switches resulting in heterodimerization and/or complex formation of the split recombinase portions resulting in formation of a functional recombinase.

Suitable split recombinases include but are not limited to e.g., split Cre recombinase as described in e.g., Beckervordersandforth R et al., Stem Cell Reports. 2014; 2(2):153-62Wen M et al., PLoS One. 2014; 9(10):e110290O'Brien S P et al., Biotechnol J. 2014; 9(3):355-61Wang P et al., Sci Rep. 2012; 2:497Hirrlinger J et al., PLoS One. 2009; 4(12): e8354Hirrlinger J et al., PLoS One. 2009; 4(1):e4286; the disclosures of which are incorporated herein by reference in their entirety.

A suitable Cre recombinase can comprise an amino acid sequence having at least about 75%, at least about 80%, at least about 85%, at least about 90%, at least about 95%, at least about 98%, or 100%, amino acid sequence identity to the following amino acid sequence: VSNLLTVHQNL-PALPVDATSDEVRKNLMDMFRDRQAFSEHTWK-MLLSVCRSWAAWC KLNNRKWFPAEPEDVRDYLLY-LQARGLAVKTIQQHLGQLNMLHRRSGLPRPSDSNAVS LVMRRIRKENVDAGERAKQALAFERTD-FDQVRSLMENSDRCQDIRRNLAFLGIAYNTLLR IAE-IARIRVKDISRTDGGRMLIHIGRTKTLVSTAGVEKA-LSLGVTKLVERWISVSGVADDP NNYLFCRVRKNGVAAPSATSQLSTRALEGIFEATH-RLIYGAKDDSGQRYLAWSGHSAR VGAARD-MARAGVSIPEIMQAGGWTNVNIVMNYIRNLDSET-GAMVRLLEDGD (SEQ ID NO:64); and can have a length of from 335 amino acids (aa) to 350 aa.

A suitable FLPe recombinase can comprise an amino acid sequence having at least about 75%, at least about 80%, at least about 85%, at least about 90%, at least about 95%, at least about 98%, or 100%, amino acid sequence identity to the following amino acid sequence: MSQFDILCKTPPKV-LVRQFVERFERPSGEKIASCAAELTYLCWMITHNG-TAIKRATFMSY NTIISNSLSFDIVNKSLQFKYKTQKA-TILEASLKKLIPAWEFTIIPYNGQKHQSDITDIVSSL QLQFESSEEADKGNSHSKKMLKALLSEGESIWEI-TEKILNSFEYTSRFTKTKTLYQFLFLA TFINCGRF-SDIKNVDPKSFKLVQNKYLGVIIQCLVTETKTSVS-RHIYFFSARGRIDPLVYL DEFLRNSEPVLKRVNRTGNSSSNKQEYQLLKDN-LVRSYNKALKKNAPYPIFAIKNGPKS HIGRHLMTS-FLSMKGLTELTNVVGNWSDKRASAVARTTYTHQI-TAIPDHYFALVSRYY AYDPISKEMIALKDETNPIEEWQHIEQLKGSAEG-SIRYPAWNGIISQEVLDYLSSYINRRIG PVEQKLI- SEEDL (SEQ ID NO:65); and can have a length of from 430 amino acids to 445 amino acids.

Suitable site-specific nucleases include, but are not limited to, an RNA-guided DNA binding protein having nuclease activity, e.g., a Cas9 polypeptide; a transcription activator-like effector nuclease (TALEN); Zinc-finger nucleases; and the like.

Cas9 polypeptides are known in the art; see, e.g., Fonfara et al. (2014) *Nucl. Acids Res.* 42:2577; and Sander and Joung (2014) *Nat. Biotechnol.* 32:347. A Cas9 polypeptide can comprise an amino acid sequence having at least about 75%, at least about 80%, at least about 85%, at least about 90%, at least about 95%, at least about 98%, or 100%, amino acid sequence identity to the amino acid sequence set forth in SEQ ID NO:163.

In some cases, the intracellular domain is a Cas9 variant that lacks nuclease activity, but retains DNA target-binding activity. Such a Cas9 variant is referred to herein as a "dead Cas9" or "dCas9." See, e.g., Qi et al. (2013) *Cell* 152:1173. A dCas9 polypeptide can comprise a D10A and/or an H840A amino acid substitution of the amino acid sequence set forth in SEQ ID NO:163 or corresponding amino acids in another Cas9 polypeptide.

In some cases, the intracellular domain is a chimeric dCas9, e.g., a fusion protein comprising dCas9 and a fusion partner, where suitable fusion partners include, e.g., a non-Cas9 enzyme that provides for an enzymatic activity, where the enzymatic activity is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some cases, the intracellular domain is a chimeric dCas9, e.g., a fusion protein comprising dCas9 and a fusion partner, where suitable fusion partners include, e.g., a non-Cas9 enzyme that provides for an enzymatic activity, where the enzymatic activity is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity.

In some cases, the intracellular domain is a chimeric dCas9, e.g., a fusion protein comprising dCas9 and a fusion partner, where suitable fusion partners include, e.g., transcription activator or a transcription repressor domain (e.g., the Kruppel associated box (KRAB or SKD); the Mad mSIN3 interaction domain (SID); the ERF repressor domain (ERD), etc.); zinc-finger-based artificial transcription factors (see, e.g., Sera (2009) *Adv. Drug Deliv.* 61:513); TALE-based artificial transcription factors (see, e.g., Liu et al. (2013) *Nat. Rev. Genetics* 14:781); and the like.

In some cases, the intracellular domain is an apoptosis inducer. A suitable apoptosis inducer includes tBID. The term "tBID" refers to the C-terminal truncated fragment of the BH3 interacting death agonist (BID) protein which results from the enzymatic cleavage of cytosolic BID (e.g., by active caspase). At an early stage of apoptosis, tBID translocates to the mitochondria and mediates the release of Cyt c therefrom. Non-limiting examples of tBID proteins include human tBID (amino acids 61-195 of the amino acid sequence provided in GenBank Accession No. CAG30275).

Human tBID has the following amino acid sequence: gnrsshsrlgrieadsesqediirniarhlaqvgdsmdrsippglvnglae-drnrdlataleqllqayprdmekektmlvlalllakkvas htpsllrdvfhttvn-finqnlrtyvrslarngmd (SEQ ID NO:66).

In some embodiments, the intracellular domain comprises an amino acid sequence having at least 75%, at least 80%, at least 85%, at least 90%, at least 95%, at least 98%, at least 99%, or 100%, amino acid sequence identity to the human tBID amino acid sequence provided above; and has a length of from about 120 amino acids (aa) to 150 aa, e.g., from 120 aa to 125 aa, from 125 aa to 130 aa, from 130 aa to 135 aa, from 135 aa to 140 aa, from 140 aa to 145 aa, or from 145 aa to 150 aa. In some cases, the intracellular domain comprises an amino acid sequence having at least 75%, at least 80%, at least 85%, at least 90%, at least 95%, at least 98%, at least 99%, or 100%, amino acid sequence identity to the human tBID amino acid sequence provided above; and has a length of 135 aa.

In some cases, the intracellular domain is a transcription factor. Examples of suitable transcription factors are those presented in Table 1 of U.S. Patent Application No. 2014/0308746. Non-limiting examples of suitable transcription factors set forth in SEQ ID Nos: 164-193. Non-limiting examples of suitable transcriptional activators and transcriptional repressors are depicted as set forth in SEQ ID Nos: 164-210. In some cases, the intracellular domain is a transcriptional regulator. Non-limiting examples of suitable transcriptional regulators include, e.g., Examples of transcriptional regulators include, e.g., ABT1, ACYP2, AEBP1, AEBP2, AES, AFF1, AFF3, AHR, ANK1, ANK2, ANKFY1, ANKIB1, ANKRD1, ANKRD10, ANKRD2, ANKRD32, ANKRD46, ANKRD49, ANKRD56, ANKRD57, ANKS4B, AR, ARHGAP17, ARID1A, ARID1B, ARID3A, ARID4A, ARID5B, ARNT, ARNT2, ARNTL, ARNTL2, ARX, ASB10, ASB11, ASB12, ASB15, ASB2, ASB5, ASB8, ASB9, ASH1L, ASH2L, ASXL1, ASZ1, ATF1, ATF3, ATF4, ATF4, ATF5, ATF6, ATF7, ATF7IP, ATM, ATOH1, ATXN3, 1300003B13RIK, B3GAT3, B930041F14RIK, BACH1, BACH2, BARX1, BARX2, BATF, BATF2, BATF3, BAZ2A, BBX, BC003267, BCL11A, BCL11B, BCL3, BCL6, BCL6B, BCLAF1, BCOR, BHLHA15, BHLHE40, BHLHE41, BLZF1, BMYC, BNC1, BNC2, BPNT1, BRCA1, BRWD1, BTBD11, BTF3, 6030408C04RIK, CAMK4, CARHSP1, CARM1, CBX4, CBX7, CCNC, CCNH, CCNT1, CCNT2, CDC5L, CDK2, CDK4, CDK9, CDKN2C, CDX1, CDX1, CDX2, CEBPA, CEBPB, CEBPD, CEBPG, CEBPG, CEBPZ, CHD4, CHD7, CHGB, CIC, CIITA, CITED1, CITED2, CITED4, CLOCK, CLPB, CML3, CNOT7, COPS2, CREB1, CREB3, CREB3L1, CREB3L1, CREB3L2, CREB3L3, CREB5, CREBBP, CREBL2, CREM, CSDA, CSDA, CSDC2, CSDE1, CTBP2, CTCF, CTCFL, CTNNB1, CTNNBL1, CXXC1, D11BWG0517E, 2300002D11RIK, DACH1, DAXX, DBP, DDIT3, DDX20, DDX54, DDX58, DEAF1, DEK, DIDO1, DLX2, DMRT1, DMRT2, DMRTB1, DNMT1, DNMT3A, DR1, DRG1, DUSP26, DYSFIP1, E2F1, E2F2, E2F3, E2F5, E2F6, EBF1, EBF2, EBF3, EBF3, EED, EGR1, EGR2, EGR3, EHF, EHMT2, EID2, ELAVL2, ELF1, ELF1, ELF2, ELF3, ELF4, ELF5, ELK3, ELK4, ELL2, EMX2, EMX2, EN2, ENPP2, EOMES, EP300, EPAS1, ERF, ERG, ESR1, ESRRA, ESRRB, ESRRG, ETS1, ETS2, ETV1, ETV3, ETV4, ETV5, ETV6, EVI1, EWSR1, EZH1, EZH2, FAH, FBXL10, FBXL11, FBXW7, FEM1A, FEM1B, FEM1C, FHL2, FLI1, FMNL2, FOS, FOSB, FOSL1, FOSL2, FOXA1, FOXA2, FOXA3, FOXC1, FOXD1, FOXD2, FOXD3, FOXF1, FOXF1A, FOXF2, FOXG1, FOXI1, FOXJ2, FOXJ3, FOXK1, FOXK2, FOXL1, FOXL2, FOXM1, FOXN1, FOXN2, FOXN3, FOXO1, FOXO3, FOXP1, FOXP2, FOXP3, FOXP4, FOXQ1, FUS, FUSIP1, 2810021G02RIK, GABPA, GABPB1, GARNL1, GAS7, GATA1, GATA2, GATA3, GATA4, GATA5, GATA5, GATA6, GBX2, GCDH, GCM1, GFI1, GFI1B, GLI2, GLI3, GLIS1, GLIS2, GLIS3, GLS2, GMEB1, GMEB2, GRHL1, GRHL2, GRHL3, GRLF1, GTF2A1, GTF2B, GTF2E2, GTF2F1, GTF2F2, GTF2H2, GTF2H4, GTF2I, GTF2IRD1, GTF2IRD1, GZF1, HAND2, HBP1, HCLS1, HDAC10, HDAC11, HDAC2, HDAC5, HDAC9, HELZ, HES1, HES4, HES5, HES6, HEXIM1, HEY2, HEYL, HHEX, HHEX, HIC1, HIC2, HIF1A, HIF1AN, HIPK2, HIVEP1, HIVEP2, HIVEP2, HIVEP3, HLF, HLTF, HLX, HMBOX1, HMG20A, HMGA2, HMGB2, HMGB3, HNF1B, HNF4A, HNF4G, HOMEZ, HOXA10, HOXA11, HOXA13, HOXA2, HOXA3, HOXA4, HOXA5, HOXA6, HOXA7, HOXA9, HOXB1, HOXB2, HOXB3, HOXB4, HOXB6, HOXB7, HOXB8, HOXB9, HOXC10, HOXC10, HOXC11, HOXC5, HOXC6, HOXC8, HOXC9, HOXD8, HOXD9, HR, HSBP1, HSF2BP, HTATIP2, HTATSF1, HUWE1, 5830417I10RIK, ID1, ID2, ID3, ID3, IFNAR2, IKBKB, IKBKG, IKZF1, IKZF2, IKZF3, IKZF4, IL31RA, ILF3, ING1, ING2, ING3, ING4, INSM1, INTS12, IQWD1, IRF1, IRF1, IRF2, IRF3, IRF4, IRF5, IRF6, IRF7, IRF8, IRF8, IRX1, IRX2, IRX3, IRX4, IRX5, ISL1, ISL2, ISX, ISX, IVNS1ABP, 2810021J22RIK, JARID1A, JARID1B, JARID1C, JARID1D, JDP2, JUN, JUNB, JUND, KLF1, KLF10, KLF11, KLF12, KLF13, KLF15, KLF16, KLF2, KLF3, KLF3, KLF4, KLF5, KLF6, KLF7, KLF8, KLF9, KRR1, 6330416L07RIK, L3MBTL2, LASS2, LASS4, LASS6, LBA1, LBH, LBX1, LCOR, LDB1, LDB2, LEF1, LHX1, LHX2, LHX5, LIMD1, LIN28, LMO1, LMO4, LMX1A, LSM11, LSM4, LYL1, 9030612M13RIK, 1810007M14RIK, 3632451O06RIK, MAF, MAFA, MAFB, MAFF, MAFG, MAFK, MAGED1, MAP3K12, MAPK1, MAPK3, MAPK8, MAPK8IP1, MAX, MAZ, MBD2, MCM2, MCM4, MCM5, MCM6, MCM7, MECOM, MECP2, MED12, MED8, MEF2A, MEF2B, MEF2C, MEF2D, MEIS1, MEIS1, MEIS2, MEOX2, MESP2, MID1, MITF, MKI67IP, MKL1, MLL1, MLL3, MLLT10, MLLT3, MLX, MLXIP, MLXIPL, MNT, MNX1, MPL, MSC, MSRB2, MSX2, MTA3, MTF1, MTF2, MTPN, MXD1, MXD4, MXI1, MYB, MYBBP1A, MYBL2, MYC, MYCBP, MYCL1, MYCN, MYEF2, MYF6, MYNN, MYOCD, MYOD1, MYOG, MYST3, MYST4, MYT1L, MZF1, NAB1, NAB2, NANOG, NARG1, NCOA1, NCOA2, NCOA3, NCOR1, NCOR2, NDN, NEUROD1, NEUROD4, NEUROD6, NEUROG1, NEUROG2, NFAT5, NFATC1, NFATC2, NFATC2IP, NFATC3, NFATC3, NFATC4, NFE2, NFE2L1, NFE2L2, NFIA, NFIA, NFIB, NFIC, NFIL3, NFIX, NFKB1, NFKB2, NFKBIB, NFKBIE, NFKBIZ, NFX1, NFXL1, NFYA, NFYB, NHLH1, NKX2-2, NKX2-3, NKX2-5, NKX2-6, NKX6-2, NMI, NOTCH1, NOTCH2, NOTCH3, NOTCH4, NPAS1, NPAS2, NPAS3, NR0B1, NR0B2, NR1D1, NR1D2, NR1H3, NR1H4, NR1I2, NR1I3, NR2C1, NR2C2, NR2E3, NR2F1, NR2F2, NR2F6, NR3C1, NR3C2, NR4A1, NR4A2, NR4A2, NR4A3, NR5A1, NR5A2, NRARP, NRIP1, NRIP2, NSBP1, NSD1, NUDT12, NULL, NUPR1, 1700065O13RIK, OLIG1, OLIG2, OLIG2, ONECUT1, ONECUT2, ONECUT3, ORC2L, OSGIN1, OSR1, OSR2, OSTF1, OVOL1, OVOL2, PAPOLA, PAPOLG, PAPPA2, PATZ1, PAWR, PAX2, PAX5, PAX6, PAX7, PAX8, PAX9, PBX1, PBX2, PBX3, PBX4, PCBD1, PCGF6, PDCD11, PDLIM4, PDX1, PEG3, PER1, PFDN1, PGR, PHF1, PHF10, PHF12, PHF13, PHF14, PHF20, PHF21A, PHF5A, PHF7, PHOX2A, PHOX2B, PIAS2, PIR, PITX1, PITX2, PKNOX1, PKNOX2, PLA2G6, PLAGL1, PLAGL2, PLRG1, PML, POGK, POLR2B, POLR2E, POLR2H, POLR3E, POLR3H, POLRMT, POU1F1, POU2AF1, POU2F1, POU2F2, POU3F2, POU3F3, POU3F3, POU5F1, POU6F1, PPARA, PPARD, PPARG, PPARGC1A, PPARGC1B, PPP1R12C, PPP1R13B, PPP1R16B, PPP1R1B, PPP2R1A, PPP3CB, PQBP1, PRDM1, PRDM14, PRDM15, PRDM16, PRDM2, PRDM4, PRDM5, PRDM6, PRDM8, PREB, PRKAR1A, PRKCBP1, PROX1, PRRX1, PRRX2, PSMC5, PSMD10, PSMD9, PTF1A, PTGES2, PURB, PWP1, RAB11A, RAB11B, RAB15, RAB18, RAB1B, RAB25, RAB8A, RAB8B, RAI14, RARA, RARB, RARG, RASSF7, RB1, RBBP7, RBL1, RBM14, RBM39, RBM9, RBPJ, RBPJL, RCOR2, REL, RELA, RELB, RERE, REST, REXO4, RFC1, RFX1, RFX2, RFX3, RFX5, RFX7, RFX8, RHOX5, RHOX6, RHOX9, RIPK4, RNF12, RNF14, RNF141, RNF38, RNF4, RORA, RORA, RORB, RORC, RPS6KA4, RREB1, RSRC1, RUNX1, RUNX1T1, RUNX2, RUNX2, RUNX3, RUVBL1, RUVBL2, RXRA, RXRG, RYBP, SAFB2, SALL1, SALL1, SALL2, SALL4, SAP30, SAP30BP, SATB1, SATB2, SATB2, SCAND1, SCAP, SCRT2, SEC14L2, SERTAD1, SF1, SFPI1, SFRS5, SH3D19, SH3PXD2B, SHANK3, SHOX2, SHPRH, SIN3A, SIN3B, SIRT2, SIRT3, SIRT5, SIX1, SIX1, SIX2, SIX3, SIX4, SIX5, SKI, SMAD1, SMAD2, SMAD3, SMAD7, SMARCA1, SMARCA2, SMARCA5, SMARCB1, SMYD1, SNAI1, SNAI2, SNAPC2, SNAPC4, SNIP1, SOLH, SOX1, SOX10, SOX11, SOX12, SOX13, SOX15, SOX17, SOX18, SOX2, SOX21, SOX4, SOX5, SOX6, SOX7, SOX8, SOX9, SP1, SP110, SP140L, SP2, SP3, SP4, SP6, SP8, SPDEF, SPEN, SPI1, SPIB, SQSTM1, SREBF1, SREBF2, SREBF2, SRF, SSBP2, SSBP3, SSBP4, SSRP1, ST18, STAG1, STAT1, STAT1, STAT2, STAT3, STAT4, STAT5A, STAT5B, STAT5B, STAT6, SUB1, SUZ12, TADA2L, TAF13, TAF5, TAF5L, TAF7, TAF9, TAL1, TAL1, TARDBP, TBPL1, TBR1, TBX1, TBX10, TBX15, TBX18, TBX2, TBX2, TBX20, TBX21, TBX3, TBX4, TBX5, TBX6, TCEA1, TCEA3, TCEAL1, TCEB3, TCERG1, TCF12, TCF15, TCF19, TCF20, TCF21, TCF21, TCF3, TCF4, TCF7, TCF7L2, TCFAP2A, TCFAP2B, TCFAP2C, TCFCP2L1, TCFE2A, TCFE3, TCFEB, TCFEC, TCFL5, TEAD1, TEAD2, TEAD3, TEAD4, TEF, TFAP2A, TFAP2C, TFCP2L1, TFDP2, TFEB, TFEC, TGFB1I1, TGIF1, TGIF2, TGIF2LX, THRA, THRAP3, THRB, THRSP, TIAL1, TLE1, TLE6, TMEM131, TMPO, TNFAIP3, TOB1, TOX4, TP63, TRERF1, TRIB3, TRIM24, TRIM28, TRIM30, TRIP13, TRIP4, TRIP6, TRP53, TRP53BP1, TRP63, TRPS1, TRPS1, TSC22D1, TSC22D2, TSC22D3, TSC22D4, TSHZ1, TSHZ1, TSHZ3, TTRAP, TUB, TULP4, TWIST1, TWIST2, TYSND1, UBE2W, UBN1, UBP1, UBTF, UGP2, UHRF1, UHRF2, UNCX, USF1, USF2, UTF1, VDR, VEZF1, VGLL2, VSX1, WASL, WHSC1, WHSC2, WT1, WWP1, WWTR1, XBP1, YAF2, YY1, ZBED1, ZBED4, ZBTB1, ZBTB10, ZBTB16, ZBTB16, ZBTB17, ZBTB2, ZBTB20, ZBTB22, ZBTB25, ZBTB32, ZBTB38, ZBTB4, ZBTB43, ZBTB45, ZBTB47, ZBTB7A, ZBTB7B, ZBTB7C, ZCCHC8, ZDHHC13, ZDHHC16, ZDHHC21, ZDHHC5, ZDHHC6, ZEB2, ANK2ZEB2, ZFHX2, ZFHX3, ZFHX4, ZFP105, ZFP110, ZFP143, ZFP148, ZFP161, ZFP192, ZFP207, ZFP219, ZFP238, ZFP263, ZFP275, ZFP277, ZFP281, ZFP287, ZFP292, ZFP35, ZFP354C, ZFP36, ZFP36L1, ZFP386, ZFP407, ZFP42, ZFP423, ZFP426, ZFP445, ZFP451, ATF5ZFP451, ZFP467, ZFP52, ZFP57, ZFP592, ZFP593, ZFP597, ZFP612, ZFP637, ZFP64, ZFP647, ZFP748, ZFP810, ZFP9, ZFP91, ZFPM1, ZFPM2, ZFX, ZHX2, ZHX3, ZIC1, ZIC2, ZIC3, ZIC4, ZIC5, ZKSCAN1, ZKSCAN3, ZMYND11, ZNF143, ZNF160, ZNF175, ZNF184, ZNF192, ZNF213, ZNF217, ZNF219, ZNF22, ZNF238, ZNF24, ZNF267, ZNF273, ZNF276, ZNF280D, ZNF281, ZNF292, ZNF311, ZNF331, ZNF335, ZNF337, ZNF33B, ZNF366, ZNF394, ZNF398, ZNF41, ZNF410, ZNF415, ZNF423, ZNF436, ZNF444, ZNF445, ZNF451, ZNF460, ZNF496, ZNF498, ZNF516, ZNF521, ZNF532, ZNF536, ZNF546, ZNF552, ZNF563, ZNF576, ZNF580, ZNF596, ZNF621, ZNF628, ZNF648, ZNF649, ZNF652, ZNF655, ZNF664, ZNF668, ZNF687, ZNF692, ZNF696, ZNF697, ZNF710, ZNF80, ZNF91, ZNF92, ZNRD1, ZSCAN10, ZSCAN16, ZSCAN20, ZSCAN21, ZXDC, and ZZZ3.

In some cases, the intracellular domain is a transcription factor. Suitable transcription factors include, e.g., ASCL1, BRN2, CDX2, CDX4, CTNNB1, EOMES, JUN, FOS, HNF4a, HOXAs (e.g., HOXA1, HOXA2, HOXA3, HOXA4, HOXA5, HOXA10, HOXA11, HOXA13), HOXBs (e.g., HOXB9), HOXCs (e.g., HOXC4, HOXC5, HOXC6, HOXC8, HOXC9, HOXC10, HOXC11, HOXC12, HOXC13), HOXDs (e.g., HOXD1, HOXD3, HOXD4, HOXD8, HOXD9, HOXD10, HOXD11, HOXD12, HOXD13), SNAIL-3, MYOD1, MYOG, NEUROD1-6 (e.g., NEUROD1, NEUROD2, NEUROD4, NEUROD6), PDX1, PU.1, SOX2, Nanog, Klf4, BCL-6, SOX9, STAT1-6, TBET, TCF, TEAD1-4 (e.g., TEAD1, TEAD2, TEAD3, TEAD4), TAF6L, CLOCK, CREB, GATA3, IRF7, MycC, NFkB, RORyt, RUNX1, SRF, TBX21, NFAT, MEF2D, and FoxP3.

In some cases, the intracellular domain is a transcription factor having a regulatory role in one or more immune cells (i.e., an immune cell regulatory transcription factor). Suitable immune cell regulatory transcription factors include, e.g., 2210012G02Rik, Akap8l, Appl2, Arid4b, Arid5b, Ash1l, Atf7, Atm, C430014K11Rik, Chd9, Dmtf1, Fos, Foxo1, Foxp1, Hmbox1, Kdm5b, Klf2, Mga, Mll1, Mll3, Myst4, Pcgf6, Rev3l, Scml4, Scp2, Smarca2, Ssbp2, Suhw4, Tcf7, Tfdp2, Tox, Zbtb20, Zbtb44, Zeb1, Zfm1, Zfp1, Zfp319, Zfp329, Zfp35, Zfp386, Zfp445, Zfp518, Zfp652, Zfp827, Zhx2, Eomes, Arnt1, Bbx, Hbp1, Jun, Mef2d, Mterfd1, Nfat5, Nfe212, Nr1d2, Phf21a, Taf4b, Trf, Zbtb25, Zfp326, Zfp451, Zfp58, Zfp672, Egr2, Ikzf2, Tafld, Chrac1, Dnajb6, Aplp2, Batf, Bhlhe40, Fosb, Hist1h1c, Hopx, Ifih1, Ikzf3, Lass4, Lin54, Mxd1, Mxi1, Prdm1, Prf1, Rora, Rpa2, Sap30, Stat2, Stat3, Taf9b, Tbx21, Trps1, Xbp1, Zeb2, Atf3, Cenpc1, Lass6, Rb1, Zbtb41, Crem, Fosl2, Gtf2b, Irf7, Maff, Nr4a1, Nr4a2, Nr4a3, Obfc2a, Rbl2, Rel, Rybp, Sra1, Tgif1, Tnfaip3, Uhrf2, Zbtb1, Ccdc124, Csda, E2f3, Epas1, H1f0, H2afz, Hif1a, Ikzf5, Irf4, Nsbp1, Pim1, Rfc2, Swap70, Tfb1m, 2610036L11Rik, 5133400G04Rik, Apitd1, Blm, Brca1, Brip1, C1d, C79407, Cenpa, Cfl1, Clspn, Ddx1, Dscc1, E2f7, E2f8, Ercc6l, Ezh2, Fen1, Foxm1, Gen1, Gsg2, H2afx, Hdac1, Hdgf, Hells, Hist1h1e, Hist3h2a, Hjurp, Hmgb2, Hmgb3, Irf1, Irf8, Kif22, Kif4, Lig1, Lmo2, Lnp, Mbd4, Mcm2, Mcm3, Mcm4, Mcm5, Mcm6, Mcm7, Mybl2, Neil3, Nusap1, Orc6l, Pola1, Pola2, Pole, Pole2, Polh, Polr2f, Polr2j, Ppp1r8, Prim2, Psmc3ip, Rad51, Rad51c, Rad54l, Rfc3, Rfc4, Rnps1, Rpa1, Smarcc1, Spic, Ssrp1, Taf9, Tfdp1, Tmpo, Topbp1, Trdmt1, Uhrf1, Wdhd1, Whsc1, Zbp1, Zbtb32, Zfp367, Car1, Polg2, Atr, Lef1, Myc, Nucb2, Satb1, Taf1a, Ift57, Apex1, Chd7, Chtf8, Ctnnb1, Etv3, Irf9, Myb, Mybbp1a, Pms2, Preb, Sp110, Stat1, Trp53, Zfp414, App, Cdk9, Ddb1, Hsf2, Lbr, Pa2g4, Rbms1, Rfc1, Rfc5, Tada21, Tex261, Xrcc6, and the like.

In some cases, a transcription factor may be an artificial transcription factor (ATF) including but not limited to e.g., Zinc-finger-based artificial transcription factors (including e.g., those described in Sera T. Adv Drug Deliv Rev. 2009 61(7-8):513-26; Collins et al. Curr Opin Biotechnol. 2003 14(4):371-8; Onori et al. BMC Mol Biol. 2013 14:3 the disclosures of which are incorporated herein by reference in their entirety).

For example, in some cases, the intracellular domain comprises an amino acid sequence having at least 75%, at least 80%, at least 85%, at least 90%, at least 95%, at least 98%, at least 99%, or 100%, amino acid sequence identity to the Apoptosis-antagonizing transcription factor (AATF) amino acid sequence set forth in SEQ ID NO: 164.

As another example, in some cases, the intracellular domain comprises an amino acid sequence having at least 75%, at least 80%, at least 85%, at least 90%, at least 95%, at least 98%, at least 99%, or 100%, amino acid sequence identity to the Activator of basal transcription (ABT1) amino acid sequence set forth in SEQ ID NO: 165.

As another example, in some cases, the intracellular domain comprises an amino acid sequence having at least 75%, at least 80%, at least 85%, at least 90%, at least 95%, at least 98%, at least 99%, or 100%, amino acid sequence identity to the adipocyte enhancer binding protein 2 amino acid sequence set forth in SEQ ID NO: 165.

As another example, in some cases, the intracellular domain comprises an amino acid sequence having at least 75%, at least 80%, at least 85%, at least 90%, at least 95%, at least 98%, at least 99%, or 100%, amino acid sequence identity to the activating transcription factor 1 (ATF1) amino acid sequence set forth in SEQ ID NO: 166.

As another example, in some cases, the intracellular domain comprises an amino acid sequence having at least 75%, at least 80%, at least 85%, at least 90%, at least 95%, at least 98%, at least 99%, or 100%, amino acid sequence identity to the transcription regulator protein BACH1 amino acid sequence set forth in SEQ ID NO: 167.

As another example, in some cases, the intracellular domain comprises an amino acid sequence having at least 75%, at least 80%, at least 85%, at least 90%, at least 95%, at least 98%, at least 99%, or 100%, amino acid sequence identity to the class E basic helix-loop-helix protein 41 amino acid sequence set forth in SEQ ID NO: 169.

As another example, in some cases, the intracellular domain comprises an amino acid sequence having at least 75%, at least 80%, at least 85%, at least 90%, at least 95%, at least 98%, at least 99%, or 100%, amino acid sequence identity to the bromodomain-containing protein amino acid sequence set forth in SEQ ID NO: 170.

As another example, in some cases, the intracellular domain comprises an amino acid sequence having at least 75%, at least 80%, at least 85%, at least 90%, at least 95%, at least 98%, at least 99%, or 100%, amino acid sequence identity to the CCAAT/enhancer-binding protein zeta amino acid sequence set forth in SEQ ID NO: 171.

As another example, in some cases, the intracellular domain comprises an amino acid sequence having at least 75%, at least 80%, at least 85%, at least 90%, at least 95%, at least 98%, at least 99%, or 100%, amino acid sequence identity to the chromodomain-helicase-DNA-binding protein 1 amino acid sequence set forth in SEQ ID NO: 172.

As another example, in some cases, the intracellular domain comprises an amino acid sequence having at least 75%, at least 80%, at least 85%, at least 90%, at least 95%, at least 98%, at least 99%, or 100%, amino acid sequence identity to the death-inducer obliterator 1 isoform c amino acid sequence set forth in SEQ ID NO: 173.

As another example, in some cases, the intracellular domain comprises an amino acid sequence having at least 75%, at least 80%, at least 85%, at least 90%, at least 95%, at least 98%, at least 99%, or 100%, amino acid sequence identity to the protein Dr1 amino acid sequence set forth in SEQ ID NO: 174.

As another example, in some cases, the intracellular domain comprises an amino acid sequence having at least 75%, at least 80%, at least 85%, at least 90%, at least 95%, at least 98%, at least 99%, or 100%, amino acid sequence identity to the early growth response protein 1 amino acid sequence set forth in SEQ ID NO: 175.

As another example, in some cases, the intracellular domain comprises an amino acid sequence having at least 75%, at least 80%, at least 85%, at least 90%, at least 95%, at least 98%, at least 99%, or 100%, amino acid sequence identity to the ETS-related transcription factor Elf-2 amino acid sequence set forth in SEQ ID NO: 176.

As another example, in some cases, the intracellular domain comprises an amino acid sequence having at least 75%, at least 80%, at least 85%, at least 90%, at least 95%, at least 98%, at least 99%, or 100%, amino acid sequence identity to the estrogen receptor amino acid sequence set forth in SEQ ID NO: 177.

As another example, in some cases, the intracellular domain comprises an amino acid sequence having at least 75%, at least 80%, at least 85%, at least 90%, at least 95%, at least 98%, at least 99%, or 100%, amino acid sequence identity to the zinc finger and BTB domain-containing protein 7A amino acid sequence set forth in SEQ ID NO: 178.

As another example, in some cases, the intracellular domain comprises an amino acid sequence having at least 75%, at least 80%, at least 85%, at least 90%, at least 95%, at least 98%, at least 99%, or 100%, amino acid sequence identity to the four and a half LIM domains protein 1 amino acid sequence set forth in SEQ ID NO: 179.

As another example, in some cases, the intracellular domain comprises an amino acid sequence having at least 75%, at least 80%, at least 85%, at least 90%, at least 95%, at least 98%, at least 99%, or 100%, amino acid sequence identity to the forkhead box protein P3 amino acid sequence set forth in SEQ ID NO: 180.

As another example, in some cases, the intracellular domain comprises an amino acid sequence having at least 75%, at least 80%, at least 85%, at least 90%, at least 95%, at least 98%, at least 99%, or 100%, amino acid sequence identity to the GA-binding protein alpha chain amino acid sequence set forth in SEQ ID NO: 181.

As another example, in some cases, the intracellular domain comprises an amino acid sequence having at least 75%, at least 80%, at least 85%, at least 90%, at least 95%, at least 98%, at least 99%, or 100%, amino acid sequence identity to the hepatic leukemia factor amino acid sequence set forth in SEQ ID NO: 182.

As another example, in some cases, the intracellular domain comprises an amino acid sequence having at least 75%, at least 80%, at least 85%, at least 90%, at least 95%, at least 98%, at least 99%, or 100%, amino acid sequence identity to the HOP amino acid sequence set forth in SEQ ID NO: 183.

As another example, in some cases, the intracellular domain comprises an amino acid sequence having at least 75%, at least 80%, at least 85%, at least 90%, at least 95%, at least 98%, at least 99%, or 100%, amino acid sequence identity to the DNA-binding protein inhibitor ID-1 amino acid sequence set forth in SEQ ID NO: 184.

As another example, in some cases, the intracellular domain comprises an amino acid sequence having at least 75%, at least 80%, at least 85%, at least 90%, at least 95%, at least 98%, at least 99%, or 100%, amino acid sequence identity to the DNA-binding protein inhibitor ID-2 (dominant negative helix-loop-helix) amino acid sequence set forth in SEQ ID NO: 185.

As another example, in some cases, the intracellular domain comprises an amino acid sequence having at least 75%, at least 80%, at least 85%, at least 90%, at least 95%, at least 98%, at least 99%, or 100%, amino acid sequence identity to the interferon regulatory factor 1 amino acid sequence set forth in SEQ ID NO: 186.

As another example, in some cases, the intracellular domain comprises an amino acid sequence having at least 75%, at least 80%, at least 85%, at least 90%, at least 95%, at least 98%, at least 99%, or 100%, amino acid sequence identity to the Krueppel-like factor 12 amino acid sequence set forth in SEQ ID NO: 187.

As another example, in some cases, the intracellular domain comprises an amino acid sequence having at least 75%, at least 80%, at least 85%, at least 90%, at least 95%, at least 98%, at least 99%, or 100%, amino acid sequence identity to the LIM domain-binding protein 1 amino acid sequence set forth in SEQ ID NO: 188.

As another example, in some cases, the intracellular domain comprises an amino acid sequence having at least 75%, at least 80%, at least 85%, at least 90%, at least 95%, at least 98%, at least 99%, or 100%, amino acid sequence identity to the LIM/homeobox protein Lhx1 amino acid sequence set forth in SEQ ID NO: 189.

As another example, in some cases, the intracellular domain comprises an amino acid sequence having at least 75%, at least 80%, at least 85%, at least 90%, at least 95%, at least 98%, at least 99%, or 100%, amino acid sequence identity to the zinc finger transcription factor E2S-VP64 amino acid sequence set forth in SEQ ID NO: 190. As another example, in some cases, the intracellular domain comprises an amino acid sequence having at least 75%, at least 80%, at least 85%, at least 90%, at least 95%, at least 98%, at least 99%, or 100%, amino acid sequence identity to the following amino acid sequence: VDALDDFDLDMLGSDALDDFDLDMLGSDALDDFDLDMLGSDALDDFDLDMLGSGGS GGSGGSLEIEAAFLERENTALETRVAELRQRVQRLRNRVSQYRTRYGPLGGGK (SEQ ID NO:67); and has a length of 105-115 amino acids (e.g., 105, 106, 107, 108, 109, 110, 111, 112, 113, 114, or 115 amino acids).

As another example, in some cases, the intracellular domain comprises an amino acid sequence having at least 75%, at least 80%, at least 85%, at least 90%, at least 95%, at least 98%, at least 99%, or 100%, amino acid sequence identity to the GAL4 DNA binding domain amino acid sequence set forth in SEQ ID NO: 191. As another example, in some cases, the intracellular domain comprises an amino acid sequence having at least 75%, at least 80%, at least 85%, at least 90%, at least 95%, at least 98%, at least 99%, or 100%, amino acid sequence identity to the following amino acid sequence: LEIRAAFLRQRNTALRTEVAELEQEVQRLENEVSQYETRYGPLGGGKGGSGGSGGSMK LLSSIEQACDICRLKKLKCSKEKPKCAKCLKNNWECRYSPKTKRSPLTRAHLTEVESRLE RLEQLFLLIFPREDLDMILKMDSLQDIKALLTGLFVQDNVNKDAVTDRLASVETDMPLT LRQHRISATSSSEESSNKGQRQLTVSAA (SEQ ID NO:68); and has a length of from 200 amino acids to 210 amino acids (e.g., 200, 201, 202, 203, 204, 205, 206, 207, 208, 209, or 210 amino acids).

As another example, in some cases, the intracellular domain comprises an amino acid sequence having at least 75%, at least 80%, at least 85%, at least 90%, at least 95%, at least 98%, at least 99%, or 100%, amino acid sequence identity to the signal transducer and activator of transcription 3 (STAT3) amino acid sequence set forth in SEQ ID NO: 192.

As another example, in some cases, the intracellular domain comprises an amino acid sequence having at least 75%, at least 80%, at least 85%, at least 90%, at least 95%, at least 98%, at least 99%, or 100%, amino acid sequence identity to the Myc amino acid sequence set forth in SEQ ID NO: 193.

As another example, in some cases, the intracellular domain comprises an amino acid sequence having at least 75%, at least 80%, at least 85%, at least 90%, at least 95%, at least 98%, at least 99%, or 100%, amino acid sequence identity to the ASCL1 amino acid sequence set forth in SEQ ID NO: 194.

As another example, in some cases, the intracellular domain comprises an amino acid sequence having at least 75%, at least 80%, at least 85%, at least 90%, at least 95%, at least 98%, at least 99%, or 100%, amino acid sequence identity to the CDX2 amino acid sequence set forth in SEQ ID NO: 195.

As another example, in some cases, the intracellular domain comprises an amino acid sequence having at least 75%, at least 80%, at least 85%, at least 90%, at least 95%, at least 98%, at least 99%, or 100%, amino acid sequence identity to the CREB1 amino acid sequence set forth in SEQ ID NO: 196.

As another example, in some cases, the intracellular domain comprises an amino acid sequence having at least 75%, at least 80%, at least 85%, at least 90%, at least 95%, at least 98%, at least 99%, or 100%, amino acid sequence identity to the CTNNB1 amino acid sequence set forth in SEQ ID NO: 197.

As another example, in some cases, the intracellular domain comprises an amino acid sequence having at least 75%, at least 80%, at least 85%, at least 90%, at least 95%, at least 98%, at least 99%, or 100%, amino acid sequence identity to the EOMES amino acid sequence set forth in SEQ ID NO: 198.

As another example, in some cases, the intracellular domain comprises an amino acid sequence having at least 75%, at least 80%, at least 85%, at least 90%, at least 95%, at least 98%, at least 99%, or 100%, amino acid sequence identity to the Fos amino acid sequence set forth in SEQ ID NO: 199.

As another example, in some cases, the intracellular domain comprises an amino acid sequence having at least 75%, at least 80%, at least 85%, at least 90%, at least 95%, at least 98%, at least 99%, or 100%, amino acid sequence identity to the GATA3 amino acid sequence set forth in SEQ ID NO: 200.

As another example, in some cases, the intracellular domain comprises an amino acid sequence having at least 75%, at least 80%, at least 85%, at least 90%, at least 95%, at least 98%, at least 99%, or 100%, amino acid sequence identity to the HOXA1 amino acid sequence set forth in SEQ ID NO: 201.

As another example, in some cases, the intracellular domain comprises an amino acid sequence having at least 75%, at least 80%, at least 85%, at least 90%, at least 95%, at least 98%, at least 99%, or 100%, amino acid sequence identity to the interferon regulatory factor 7 (IRF7) amino acid sequence set forth in SEQ ID NO: 202.

As another example, in some cases, the intracellular domain comprises an amino acid sequence having at least 75%, at least 80%, at least 85%, at least 90%, at least 95%, at least 98%, at least 99%, or 100%, amino acid sequence identity to the Jun amino acid sequence set forth in SEQ ID NO: 203.

As another example, in some cases, the intracellular domain comprises an amino acid sequence having at least 75%, at least 80%, at least 85%, at least 90%, at least 95%, at least 98%, at least 99%, or 100%, amino acid sequence identity to the myocyte enhancer factor 2D (MEF2D) amino acid sequence set forth in SEQ ID NO: 204.

As another example, in some cases, the intracellular domain comprises an amino acid sequence having at least 75%, at least 80%, at least 85%, at least 90%, at least 95%, at least 98%, at least 99%, or 100%, amino acid sequence identity to the neuronal differentiation factor 1 (NEUROD1) amino acid sequence set forth in SEQ ID NO: 205.

As another example, in some cases, the intracellular domain comprises an amino acid sequence having at least 75%, at least 80%, at least 85%, at least 90%, at least 95%, at least 98%, at least 99%, or 100%, amino acid sequence identity to the NFAT amino acid sequence set forth in SEQ ID NO: 206.

As another example, in some cases, the intracellular domain comprises an amino acid sequence having at least 75%, at least 80%, at least 85%, at least 90%, at least 95%, at least 98%, at least 99%, or 100%, amino acid sequence identity to the NFκB amino acid sequence set forth in SEQ ID NO: 207.

As another example, in some cases, the intracellular domain comprises an amino acid sequence having at least 75%, at least 80%, at least 85%, at least 90%, at least 95%, at least 98%, at least 99%, or 100%, amino acid sequence identity to the SNAI1 amino acid sequence set forth in SEQ ID NO: 208.

As another example, in some cases, the intracellular domain comprises an amino acid sequence having at least 75%, at least 80%, at least 85%, at least 90%, at least 95%, at least 98%, at least 99%, or 100%, amino acid sequence identity to the STAT1 amino acid sequence set forth in SEQ ID NO: 209.

As another example, in some cases, the intracellular domain comprises an amino acid sequence having at least 75%, at least 80%, at least 85%, at least 90%, at least 95%, at least 98%, at least 99%, or 100%, amino acid sequence identity to the TEAD1 amino acid sequence set forth in SEQ ID NO: 210.

In some embodiments, the intracellular domain is a transcriptional activator. In some cases, the intracellular domain comprises an amino acid sequence having at least 75%, at least 80%, at least 85%, at least 90%, at least 95%, at least 98%, at least 99%, or 100%, amino acid sequence identity to the following tetracycline-controlled transcriptional activator (tTA) amino acid sequence: MSRLDKSKVIN-SALELLNEVGIEGLTTRKLAQKLGVEQPTLY-WHVKNKRALLDALAIE MLDRHHTHFCPLEGESWQDFLRNNAKS-FRCALLSHRDGAKVHLGTRPTEKQYETLENQ LAFL-CQQGFSLENALYALSAVGHFTLGCVLEDQEHQVA-KEERETPTTDSMPPLLRQAIE LFDHQGAEPAFLFGLELIICGLEKQLKCESGG-PADALDDFDLDMLPADALDDFDLDMLP ADALDD-FDLDMLPG (SEQ ID NO:69); and has a length of from about 245 amino acids to 252 amino acids (e.g., 248, 249, 250, 251, or 252 amino acids).

In some embodiments, the intracellular domain is a transcriptional activator. In some cases, the transcriptional activator is GAL4-VP16. In some cases, the transcriptional activator is GAL4-VP64. In some cases, the transcriptional activator is Tbx21. In some cases the transcriptional activator is an engineered protein, such as a zinc finger or TALE based DNA binding domain fused to an effector domain such as VP64 (transcriptional activation) or KRAB (transcriptional repression). A variety of other transcriptional transactivators are known in the art is suitable for use.

In some cases, the intracellular domain comprises an amino acid sequence having at least 75%, at least 80%, at least 85%, at least 90%, at least 95%, at least 98%, at least 99%, or 100%, amino acid sequence identity to the following GAL4-VP64 sequence: MKLLSSIEQACDICRLK-KLKCSKEKPKCAKCLKNNWECRYSPKTKRSPL-TRAHLTEVES RLERLEQLFLLIFPREDLDMILKMDSLQDIKALLT-GLFVQDNVNKDAVTDRLASVETDM PLTLRQHRI-SATSSSEESSNKGQRQLTVSAAAGGSGGSGGS-DALDDFDLDMLGSDALDD FDLDMLGSDALDDFDLDMLGSDALDDFDLDMLGS (SEQ ID NO:70); and has a length of from 208 to 214 amino acids (e.g., 208, 209, 210, 211, 212, 213, or 214 amino acids).

In some cases, the intracellular domain comprises an amino acid sequence having at least 75%, at least 80%, at least 85%, at least 90%, at least 95%, at least 98%, at least 99%, or 100%, amino acid sequence identity to the following Tbx21 sequence: MGIVEPGCGDMLTGTEPMPGSDE-GRAPGADPQHRYFYPEPGAQDADERRGGGSLGSPY PGGALVPAPPSRFLGAYAYPPRPQAAGFPGAGESFPP-PADAEGYQPGEGYAAPDPRAGL YPGPREDYALPAG-LEVSGKLRVALNNHLLWSKFNQHQTEMIITKQGR-RMFPFLSFTVAG LEPTSHYRMFVDVVLVDQHHWRYQSGKWVQCG-KAEGSMPGNRLYVHPDSPNTGAH WMRQEVSFG-KLKLTNNKGASNNVTQMIVLQSLHKYQPRL-HIVEVNDGEPEAACNASN THIFTFQETQFIAVTAYQNAEITQLKIDNNPFAKG-FRENFESMYTSVDTSIPSPPGPNCQFL GGDHYSPLLP-NQYPVPSRFYPDLPGQAKDVVPQAYWLGAPRDHS-YEAEFRAVSMKPAF LPSAPGPTMSYYRGQEVLAPGAGWPVAPQYPPKMG-PASWFRPMRTLPMEPGPGGSEGR GPEDQGPPLVW-TEIAPIRPESSDSGLGEGDSKRRRVSPYPSSGDSSSPA-GAPSPFDKEAEG QFYNYFPN (SEQ ID NO:71); and has a length of from 530 amino acids to 540 amino acids (e.g., 530, 531, 532, 533, 534, 535, 536, 537, 538, 539, or 540 amino acids).

In some cases, the intracellular domain comprises an amino acid sequence having at least 75%, at least 80%, at least 85%, at least 90%, at least 95%, at least 98%, at least 99%, or 100%, amino acid sequence identity to the following MyoD amino acid sequence: MELLSPPLRDIDLTGP-DGSLCSFETADDFYDDPCFDSPDLRFFEDLDPRLVH-MGALLKPE EHAHFPTAVHPGPGAREDEHVRAPSGHHQAGR-CLLWACKACKRKTTNADRRKAATM RERRRLSK-VNEAFETLKRCTSSNPNQRLPKVEILR-NAIRYIEGLQALLRDQDAAPPGAAA FYAPGPLPPGRGSEHYSGDSDASSPRSNCSDGM-MDYSGPPSGPRRQNGYDTAYYSEAA RESRPGK-SAAVSSLDCLSSIVERISTDSPAAPALLLADAPPESP-PGPPEGASLSDTEQGTQT PSPDAAPQCPAGSNPNAIYQVL (SEQ ID NO:72); and has a length of from 305 to 325 amino acids (e.g., 305, 306, 307, 308, 309, 310, 311, 312, 313, 314, 315, 316, 317, 318, 319, 320, 321, 322, 323, 324, or 325 amino acids).

In some cases, the intracellular domain comprises a toxin. Examples of toxins include, e.g., diphtheria toxin A fragment, nonbinding active fragments of diphtheria toxin, exotoxin A (from *Pseudomonas aeruginosa*), ricin A chain, abrin A chain, modeccin A chain, α-sacrin, certain *Aleurites fordii* proteins, certain Dianthin proteins, *Phytolacca americana* proteins (PAP, PAPII and PAP-S), *Morodica charantia* inhibitor, curcin, crotin, *Saponaria officinalis* inhibitor, gelonin, mitogillin, restrictocin, phenomycin, and neomycin. In some cases, the intracellular domain comprises a protein that is normally secreted by a bacterial pathogen via a Type II secretion system. In some cases, the intracellular domain comprises a toxic bacterial effector from Type III (e.g., *Salmonella, Shigella, Yersinia, Vibrio*) and type IV (e.g., *Bordetella pertussis, Legionella pneumophila, Agrobacterium tumefaciens*) secretion systems. Examples of toxic bacterial effectors from Type III bacterial secretion systems include, e.g., VopQ, YopH, and the like. See, e.g., Dean (2011) *FEMS Microbiol. Rev.* 35:1100. Examples of toxic bacterial effectors from Type IV bacterial secretion systems include, e.g., pertussis toxin, CagA, and the like.

In some cases, the intracellular domain of a chimeric Notch receptor polypeptide of the present disclosure is a hormone. Examples of suitable hormones include, e.g., erythropoietin (EPO), insulin, secretins, glucagon-like polypeptide 1 (GLP-1), and the like. Further examples of such hormones include, but are not limited to, activin, inhibin, adiponectin, adipose-derived hormones, adrenocorticotropic hormone, Afamelanotide, agouti signaling peptide, Allatostatin, Amylin, Amylin family, angiotensin, atrial natriuretic peptide, gastrin, somatotropin, bradykinin, brain-derived neurotrophic factor, calcitonin, cholecystokinin, ciliary neurotrophic factor, corticotropin-releasing hormone, cosyntropin, endothelian, enteroglucagon, fibroblast growth factor 15 (FGF15), GFG15/19, follicle-stimulating hormone, gastrin, gastroinhibitory peptide, ghrelin, glucagon, glucagon-like peptide-1, gonadotropin, gonadotropin-releasing hormone, granulocyte-colony-stimulating factor, growth hormone, growth-hormone-releasing hormone, hepcidin, human chorionic gonadotropin, human placental lactogen, incretin, insulin, insulin analog, insulin aspart, insulin degludec, insulin glargine, insulin lispro, insulin-like growth factor, insulin-like growth factor-1, insulin-like growth factor-2, leptin, liraglutide, luteinizing hormone, melanocortin, melanocyte-stimulating hormone, alpha-melanocyte-stimulating hormone, melanotin II, minigastrin, N-terminal prohormone of brain natriuretic peptide, nerve growth factor, neurotrophin-3, neurotrophin-4, NPH insulin, obestatin, orexin, osteocalcin, pancreatic hormone, parathyroid hormone, peptide hormone, peptide YY, plasma renin activity, pramlintide, preprohormone, prolactin, relaxin, relaxin family peptide hormone, renin, salcatonin, secretin, secretin family peptide hormone, sincalide, teleost leptins, temporin, tesamorelin, thyroid-stimulating hormone, thyrotropin-releasing hormone, urocortin, urocortin II, urocortin III, vasoactive intestinal peptide, and vitellogenin.

In some cases, the intracellular domain of a chimeric Notch receptor polypeptide of the present disclosure is a growth factor. Examples of suitable growth factors include, but are not limited to, hepatocyte stimulating factor, plasmacytoma growth factor, brain derived neurotrophic factor (BDNF), glial derived neurotrophic factor (GDNF), neurotrophic factor 3 (NT3), fibroblast growth factor (FGF), transforming growth factor (TGF), platelet transforming growth factor, milk growth factor, endothelial growth factors (EGF), endothelial cell-derived growth factors (ECDGF), alpha-endothelial growth factor, beta-endothelial growth factor, neurotrophic growth factor, nerve growth factor (NGF), vascular endothelial growth factor (VEGF), 4-1 BB receptor (4-1BBR), TRAIL (TNF-related apoptosis inducing ligand), artemin (GFRalpha3-RET ligand), BCA-1 (B cell-attracting chemokine1), B lymphocyte chemoattractant (BLC), B cell maturation protein (BCMA), brain-derived neurotrophic factor (BDNF), bone growth factor such as osteoprotegerin (OPG), bone-derived growth factor, megakaryocyte derived growth factor (MGDF), keratinocyte growth factor (KGF), thrombopoietin, platelet-derived growth factor (PGDF), megakaryocyte derived growth factor (MGDF), keratinocyte growth factor (KGF), platelet-derived growth factor (PGDF), neurotrophin-2 (NT-2), neurotrophin-3 (NT-3), neurotrophin-4 (NT4), neurotrophin-5 (NT-5), glial cell line-derived neurotrophic factor (GDNF), ciliary neurotrophic factor (CNTF), bone Morphogenetic protein 2 (BMP2), granulocyte macrophage colony stimulating factor (GM-CSF), granulocyte colony stimulating factor (G-CSF), macrophage colony stimulating factor (M-CSF), colony stimulating factor (CSF), and the like.

In some cases, the intracellular domain of a chimeric Notch receptor polypeptide of the present disclosure is a cytokine. Examples of suitable cytokines include, e.g., interferons (e.g., an alpha-interferon, a beta-interferon, a gamma-interferon); interleukins (e.g., IL-1, IL-1α, IL-2, IL-3, IL-4, IL-5, IL-6, IL-7, IL-8, IL-9, IL-10 IL-11, IL-12; IL-13, IL-14, IL-15, IL-16, IL-17, IL-17A, IL-18, IL-19, IL-20, IL-24); tumor necrosis factors (e.g., TNF-α); transforming growth factor-beta; TRAIL; and the like. Examples of suitable cytokines also include flexi-12 (Anderson et al. (1997) *Hum. Gene Ther.* 8:1125), a single chain polypeptide that combines the two polypeptide chains of an IL-12 heterodimer); IL-12 superkine H9 (Levin et al. (2012) *Nature* 484:529); and the like.

In some cases, the intracellular domain of a chimeric Notch receptor polypeptide of the present disclosure is a chemokine. Examples of suitable chemokines include, e.g., MIP-1, MIP-1β, MCP-1, RANTES, IP10, and the like. Additional examples of suitable chemokines include, but are not limited to, chemokine (C-C motif) ligand-2 (CCL2; also referred to as monocyte chemotactic protein-1 or MCP1); chemokine (C-C motif) ligand-3 (CCL3; also known as macrophage inflammatory protein-1A or MIP1A); chemokine (C-C motif) ligand-5 (CCL5; also known as RANTES); chemokine (C-C motif) ligand-17 (CCL17; also known as thymus and activation regulated chemokine or TARC); chemokine (C-C motif) ligand-19 (CCL19; also known as EBI1 ligand chemokine or ELC); chemokine (C-C motif) ligand-21 (CCL21; also known as 6Ckine); C-C chemokine receptor type 7 (CCR7); chemokine (C-X-C motif) ligand 9 (CXCL9; also known as monokine induced by gamma interferon or MIG); chemokine (C-X-C motif) ligand 10 (CXCL10; also known as interferon gamma-induced protein 10 or IP-10); chemokine (C-X-C motif) ligand 11 (CXCL11; also called interferon-inducible T-cell alpha chemoattractant or I-TAC); chemokine (C-X-C motif) ligand 16 (CXCL16; chemokine (C motif) ligand (XCL1; also known as lymphotactin); and macrophage colony-stimulating factor (MCSF).

In some cases, the intracellular domain of a binding triggered transcriptional switch, e.g., a chimeric Notch receptor polypeptide, of the present disclosure is an antibody (or an antigen-binding fragment of an antibody). Suitable antibodies include, e.g., Natalizumab (Tysabri; Biogen Idec/Elan) targeting α4 subunit of α4β1 and α4β7 integrins (as used in the treatment of MS and Crohn's disease); Vedolizumab (MLN2; Millennium Pharmaceuticals/Takeda) targeting α4β7 integrin (as used in the treatment of UC and Crohn's disease); Belimumab (Benlysta; Human Genome Sciences/GlaxoSmithKline) targeting BAFF (as used in the treatment of SLE); Atacicept (TACI-Ig; Merck/Serono) targeting BAFF and APRIL (as used in the treatment of SLE); Alefacept (Amevive; Astellas) targeting CD2 (as used in the treatment of Plaque psoriasis, GVHD); Otelixizumab (TRX4; Tolerx/GlaxoSmithKline) targeting CD3 (as used in the treatment of T1D); Teplizumab (MGA031; MacroGenics/Eli Lilly) targeting CD3 (as used in the treatment of T1D); Rituximab (Rituxan/Mabthera; Genentech/Roche/Biogen Idec) targeting CD20 (as used in the treatment of Non-Hodgkin's lymphoma, RA (in patients with inadequate responses to TNF blockade) and CLL); Ofatumumab (Arzerra; Genmab/GlaxoSmithKline) targeting CD20 (as used in the treatment of CLL, RA); Ocrelizumab (2H7; Genentech/Roche/Biogen Idec) targeting CD20 (as used in the treatment of RA and SLE); Epratuzumab (hLL2; Immunomedics/UCB) targeting CD22 (as used in the treatment of SLE and non-Hodgkin's lymphoma); Alemtuzumab (Campath/MabCampath; Genzyme/Bayer) targeting CD52 (as used in the treatment of CLL, MS); Abatacept (Orencia; Bristol-Myers Squibb) targeting CD80 and CD86 (as used in the treatment of RA and JIA, UC and Crohn's disease, SLE); Eculizumab (Soliris; Alexion pharmaceuticals) targeting C5 complement protein (as used in the treatment of Paroxysmal nocturnal haemoglobinuria); Omalizumab (Xolair; Genentech/Roche/Novartis) targeting IgE (as used in the treatment of Moderate to severe persistent allergic asthma); Canakinumab (Ilaris; Novartis) targeting IL-1β (as used in the treatment of Cryopyrin-associated periodic syndromes, Systemic JIA, neonatal-onset multisystem inflammatory disease and acute gout); Mepolizumab (Bosatria; GlaxoSmithKline) targeting IL-5 (as used in the treatment of Hyper-eosinophilic syndrome); Reslizumab (SCH55700; Ception Therapeutics) targeting IL-5 (as used in the treatment of Eosinophilic oesophagitis); Tocilizumab (Actemra/RoActemra; Chugai/Roche) targeting IL-6R (as used in the treatment of RA, JIA); Ustekinumab (Stelara; Centocor) targeting IL-12 and IL-23 (as used in the treatment of Plaque psoriasis, Psoriatic arthritis, Crohn's disease); Briakinumab (ABT-874; Abbott) targeting IL-12 and IL-23 (as used in the treatment of Psoriasis and plaque psoriasis); Etanercept (Enbrel; Amgen/Pfizer) targeting TNF (as used in the treatment of RA, JIA, psoriatic arthritis, AS and plaque psoriasis); Infliximab (Remicade; Centocor/Merck) targeting TNF (as used in the treatment of Crohn's disease, RA, psoriatic arthritis, UC, AS and plaque psoriasis); Adalimumab (Humira/Trudexa; Abbott) targeting TNF (as used in the treatment of RA, JIA, psoriatic arthritis, Crohn's disease, AS and plaque psoriasis); Certolizumab pegol (Cimzia; UCB) targeting TNF (as used in the treatment of Crohn's disease and RA); Golimumab (Simponi; Centocor) targeting TNF (as used in the treatment of RA, psoriatic arthritis and AS); and the like. In some cases, the antibody whose production is induced by the intracellular domain of a synNotch polypeptide of the present disclosure is a therapeutic antibody for the treatment of cancer. Such antibodies include, e.g., Ipilimumab targeting CTLA-4 (as used in the treatment of Melanoma, Prostate Cancer, RCC); Tremelimumab targeting CTLA-4 (as used in the treatment of CRC, Gastric, Melanoma, NSCLC); Nivolumab targeting PD-1 (as used in the treatment of Melanoma, NSCLC, RCC); MK-3475 targeting PD-1 (as used in the treatment of Melanoma); Pidilizumab targeting PD-1 (as used in the treatment of Hematologic Malignancies); BMS-936559 targeting PD-L1 (as used in the treatment of Melanoma, NSCLC, Ovarian, RCC); MEDI4736 targeting PD-L1; MPDL33280A targeting PD-L1 (as used in the treatment of Melanoma); Rituximab targeting CD20 (as used in the treatment of Non-Hodgkin's lymphoma); Ibritumomab tiuxetan and tositumomab (as used in the treatment of Lymphoma); Brentuximab vedotin targeting CD30 (as used in the treatment of Hodgkin's lymphoma); Gemtuzumab ozogamicin targeting CD33 (as used in the treatment of Acute myelogenous leukaemia); Alemtuzumab targeting CD52 (as used in the treatment of Chronic lymphocytic leukaemia); IGN101 and adecatumumab targeting EpCAM (as used in the treatment of Epithelial tumors (breast, colon and lung)); Labetuzumab targeting CEA (as used in the treatment of Breast, colon and lung tumors); huA33 targeting gpA33 (as used in the treatment of Colorectal carcinoma); Pemtumomab and oregovomab targeting Mucins (as used in the treatment of Breast, colon, lung and ovarian tumors); CC49 (minretumomab) targeting TAG-72 (as used in the treatment of Breast, colon and lung tumors); cG250 targeting CAIX (as used in the treatment of Renal cell carcinoma); J591 targeting PSMA (as used in the treatment of Prostate carcinoma); MOv18 and MORAb-003 (farletuzumab) targeting Folate-binding protein (as used in the treatment of Ovarian tumors); 3F8, ch14.18 and KW-2871 targeting Gangliosides (such as GD2, GD3 and GM2) (as used in the treatment of Neuroectodermal tumors and some epithelial tumors); hu3S193 and IgN311 targeting Le y (as used in the treatment of Breast, colon, lung and prostate tumors); Bevacizumab targeting VEGF (as used in the treatment of Tumor vasculature); IM-2C6 and CDP791 targeting VEGFR (as used in the treatment of Epithelium-derived solid tumors); Etaracizumab targeting Integrin_V_3 (as used in the treatment of Tumor vasculature); Volociximab targeting Integrin_5_1 (as used in the treatment of Tumor vasculature); Cetuximab, panitumumab, nimotuzumab and 806 targeting EGFR (as used in the treatment of Glioma, lung, breast, colon, and head and neck tumors); Trastuzumab and pertuzumab targeting ERBB2 (as used in the treatment of Breast, colon, lung, ovarian and prostate tumors); MM-121 targeting ERBB3 (as used in the treatment of Breast, colon, lung, ovarian and prostate, tumors); AMG 102, METMAB and SCH 900105 targeting MET (as used in the treatment of Breast, ovary and lung tumors); AVE1642, IMC-A12, MK-0646, R1507 and CP 751871 targeting IGF1R (as used in the treatment of Glioma, lung, breast, head and neck, prostate and thyroid cancer); KB004 and IIIA4 targeting EPHA3 (as used in the treatment of Lung, kidney and colon tumors, melanoma, glioma and haematological malignancies); Mapatumumab (HGS-ETR1) targeting TRAILR1 (as used in the treatment of Colon, lung and pancreas tumors and haematological malignancies); HGS-ETR2 and CS-1008 targeting TRAILR2; Denosumab targeting RANKL (as used in the treatment of Prostate cancer and bone metastases); Sibrotuzumab and F19 targeting FAP (as used in the treatment of Colon, breast, lung, pancreas, and head and neck tumors); 8106 targeting Tenascin (as used in the treatment of Glioma, breast and prostate tumors); Blinatumomab (Blincyto; Amgen) targeting CD3 (as used in the treatment of ALL); pembrolizumab targeting PD-1 as used in cancer immunotherapy; 9E10 antibody targeting c-Myc; and the like.

Antibodies that may find use, in whole or in part, in the intracellular domain of a binding triggered transcriptional switch also include but are not limited to 8H9, Abagovomab, Abciximab, Abituzumab, Abrilumab, Actoxumab, Aducanumab, Afelimomab, Afutuzumab, Alacizumab pegol, ALD518, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab/tocilizumab, Atorolimumab, Bapineuzumab, Basiliximab, B avituximab, Bectumomab, Begelomab, Benralizumab, Bertilimumab, Besilesomab, Bevacizumab/Ranibizumab, Bezlotoxumab, Biciromab, Bimagrumab, Bimekizumab, Bivatuzumab mertansine, Blosozumab, Bococizumab, Brentuximabvedotin, Brodalumab, Brolucizumab, Brontictuzumab, Cantuzumab mertansine, Cantuzumab ravtansine, Caplacizumab, Capromab pendetide, Carlumab, Catumaxomab, cBR96-doxorubicin immunoconjugate, Cedelizumab, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Derlotuximab biotin, Detumomab, Dinutuximab, Diridavumab, Dorlimomab aritox, Drozitumab, Duligotumab, Dupilumab, Durvalumab, Dusigitumab, Ecromeximab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Erlizumab, Ertumaxomab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gevokizumab, Girentuximab, Glembatumumab vedotin, Gomiliximab, Guselkumab, Ibalizumab, Ibalizumab, Icrucumab, Idarucizumab, Igovomab, IMAB362, Imalumab, Imciromab, Imgatuzumab, Inclacumab, Indatuximab ravtansine, Indusatumab vedotin, Inolimomab, Inotuzumab ozogamicin, Intetumumab, Iratumumab, Isatuximab, Itolizumab, Ixekizumab, Keliximab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Margetuximab, Maslimomab, Matuzumab, Mavrilimumab, Metelimumab, Milatuzumab, Minretumomab, Mirvetuximab soravtansine, Mitumomab, Mogamulizumab, Morolimumab, Morolimumab immune, Motavizumab, Moxetumomab pasudotox, Muromonab-CD3, Nacolomab tafenatox, Namilumab, Naptumomab estafenatox, Narnatumab, Nebacumab, Necitumumab, Nemolizumab, Nerelimomab, Nesvacumab, Nofetumomab merpentan, Obiltoxaximab, Obinutuzumab, Ocaratuzumab, Odulimomab, Olaratumab, Olokizumab, Onartuzumab, Ontuxizumab, Opicinumab, Oportuzumab monatox, Orticumab, Otlertuzumab, Oxelumab, Ozanezumab, Ozoralizumab, Pagibaximab, Palivizumab, Pankomab, Panobacumab, Parsatuzumab, Pascolizumab, Pasotuxizumab, Pateclizumab, Patritumab, Perakizumab, Pexelizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Rilotumumab, Rinucumab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teprotumumab, Tesidolumab, Tetulomab, TGN1412, Ticilimumab/tremelimumab, Tigatuzumab, Tildrakizumab, TNX-650, Toralizumab, Tosatoxumab, Tovetumab, Tralokinumab, TRBS07, Tregalizumab, Trevogrumab, Tucotuzumab celmoleukin, Tuvirumab, Ublituximab, Ulocuplumab, Urelumab, Urtoxazumab, Vandortuzumab vedotin, Vantictumab, Vanucizumab, Vapaliximab, Varlilumab, Vatelizumab, Veltuzumab, Vepalimomab, Vesencumab, Visilizumab, Vorsetuzumab mafodotin, Votumumab, Zalutumumab, Zanolimumab, Zatuximab, Ziralimumab, Zolimomab aritox, and the like.

In some cases, the intracellular domain of a chimeric Notch receptor polypeptide of the present disclosure is a neuropeptide. Examples of suitable neuropeptides include, but are not limited to, N-Acetylaspartylglutamic acid, agouti-related peptide, alpha-endorphin, big dynorphin, bombesin, bombesin-like peptides, carbetocin, cocaine-and-amphetamine regulated transcript (CART), cholecystokinin, corazonin, corticotropin-like intermediate peptide, cortistatin, demoxytocin, dynorphin A, dynorphin B, eledoisin, enkephalin, galanin, galanin-like peptide, galmic, galnon, gamma-endorphin, ghrelin, hemopressin, kisspeptin, neurokinin B, neuromedin B, neuromedin N, neuromedin S, neuromedin U, neuromedin S, neuromedin Y, neuropeptide Y, neurotensin, nociceptin, opiorphin, orexin, orexin-A, oxytocin, physalaemin, preprotachykinin, proctolin, proenkephalin, poopiomelanocortin, protein episteme, relaxin-3, somatostatin, substance P, TAC1, tachykinin peptides, vasopressin, and vasotocin.

Gene Products Induced by a Released Intracellular Domain of a synNotch Polypeptide In some cases, the intracellular domain is a polypeptide that, when released upon binding of the first member of the specific binding pair to a second member of the specific binding pair, induces production, in a cell that expresses the chimeric Notch polypeptide, of a gene product. For example, in some cases, the intracellular domain of a chimeric Notch receptor polypeptide of the present disclosure, when released upon binding of the first member of the specific binding pair to a second member of the specific binding pair, induces production of a gene product (a polypeptide; a nucleic acid) in a cell that expresses the chimeric Notch polypeptide. In some cases, the gene product is a nucleic acid. In some cases, the gene product is a polypeptide. Polypeptide gene products induced by the released intracellular domain include endogenous polypeptides (e.g., polypeptides naturally encoded by the cell) and heterologous polypeptides (e.g., polypeptides not naturally encoded by the cell; polypeptides encoded by a heterologous nucleic acid used to genetically modify the cell). Polypeptide gene products induced by the released intracellular domain include secreted polypeptides. Polypeptide gene products induced by the released intracellular domain include cell surface polypeptides. Polypeptide gene products induced by the released intracellular domain include intracellular polypeptides (polypeptides that normally are present intracellularly, such as transcription factors). Polypeptide gene products induced by the released intracellular domain include receptors, cytokines, hormones, growth factors, chemokines, cell surface polypeptides, transcription factors (e.g., transcription activators; transcription repressors), apoptosis inducers, apoptosis inhibitors, dominant-negative variants, etc. Polypeptide gene products whose production can be induced by the released intracellular domain include transcriptional activators, transcriptional repressors, a chimeric antigen receptor, a T-cell receptor (TCR), a second chimeric Notch polypeptide, a CAR, a translation regulator, an immune inhibitory receptor, an immune inhibitory protein, an immune activating protein, a cytokine receptor, a chemokine receptor, a DNA-binding protein, an epigenetic regulator, an RNA-guided endonuclease (e.g., a Cas9 polypeptide), an enzymatically inactive Cas9 polypeptide, a site-specific nuclease, a recombinase, a transcription factor that induces differentiation, a transcription factor that induces dedifferentiation, and the like.

In some cases, the intracellular domain of a chimeric Notch receptor polypeptide of the present disclosure, when released upon binding of the first member of the specific binding pair to a second member of the specific binding pair, induces production of an endogenous gene product in a cell that expresses the chimeric Notch polypeptide. Endogenous gene products include, e.g., a chemokine, a chemokine receptor, a cytokine, a cytokine receptor, a differentiation factor, a growth factor, a growth factor receptor, a hormone, a metabolic enzyme, a proliferation inducer, a receptor, a small molecule second messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis in inhibitor, an apoptosis inducer, an immunoactivator, an immunoinhibitor, and an inhibiting immunoreceptor.

In some cases, the intracellular domain of a chimeric Notch receptor polypeptide of the present disclosure, when released upon binding of the first member of the specific binding pair to a second member of the specific binding pair, induces production of a heterologous gene product in a cell that expresses the chimeric Notch polypeptide. Heterologous gene products include gene products not normally produced by the cell. For example, the cell can be genetically modified with a nucleic acid comprising a nucleotide sequence encoding a heterologous gene product. Heterologous gene products include, e.g., a chemokine, a chemokine receptor, a chimeric antigen receptor, a cytokine, a cytokine receptor, a differentiation factor, a growth factor, a growth factor receptor, a hormone, a metabolic enzyme, a pathogen derived protein, a proliferation inducer, a receptor, a RNA guided nuclease, a site-specific nuclease, a small molecule second messenger synthesis enzyme, a T cell receptor, a toxin derived protein, a transcription activator, a transcription repressor, a transcriptional activator, a transcriptional repressor, a translation regulator, a translational activator, a translational repressor, an activating immunoreceptor, an antibody, an apoptosis in inhibitor, an apoptosis inducer, an engineered T cell receptor, an immunoactivator, an immunoinhibitor, an inhibiting immunoreceptor, an RNA guided DNA binding protein, a T-cell receptor (TCR), a MESA polypeptide, a TANGO polypeptide, and a second synNotch polypeptide (where the second synNotch polypeptide is different from the synNotch polypeptide whose intracellular domain induced production of the second synNotch polypeptide).

Polypeptide gene products that can be induced by the released intracellular domain include secreted polypeptides. Non-limiting examples of secreted polypeptides include, e.g., IL-2, IL-7, TNFalpha, IL-12, GMCSF, EGF, TGFbeta, IL-10, IL-17, IL-4, IL-5, IL-13, IFNalpha, IFNgamma, HMG-B1, secreted PTEN, Wnt, and single chain antibodies. Polypeptide gene products that can be induced by the released intracellular domain include dominant negative polypeptides. Examples of dominant negative polypeptides include, e.g., a dominant negative TGF-β receptor; a dominant negative variant of STAT3 comprising one or more mutations affecting the DNA binding domain of STAT3 that functions as a dominant negative variant; and the like.

In some cases, the intracellular domain of a chimeric Notch receptor polypeptide of the present disclosure, when released upon binding of the first member of the specific binding pair to a second member of the specific binding pair, induces production of a hormone in a cell that expresses the chimeric Notch polypeptide. Examples of such hormones include, e.g., erythropoietin (EPO), insulin, secretins, glucagon-like polypeptide 1 (GLP-1), and the like. Further examples of such hormones include, but are not limited to, activin, inhibin, adiponectin, adipose-derived hormones, adrenocorticotropic hormone, afamelanotide, agouti signaling peptide, allatostatin, amylin, angiotensin, atrial natriuretic peptide, gastrin, somatotropin, bradykinin, brain-derived neurotrophic factor, calcitonin, cholecystokinin, ciliary neurotrophic factor, corticotropin-releasing hormone, cosyntropin, endothelian, enteroglucagon, fibroblast growth factor 15 (FGF15), GFG15/19, follicle-stimulating hormone, gastrin, gastroinhibitory peptide, ghrelin, glucagon, glucagon-like peptide-1, gonadotropin, gonadotropin-releasing hormone, granulocyte-colony-stimulating factor, growth hormone, growth-hormone-releasing hormone, hepcidin, human chorionic gonadotropin, human placental lactogen, incretin, insulin, insulin analog, insulin aspart, insulin degludec, insulin glargine, insulin lispro, insulin-like growth factor, insulin-like growth factor-1, insulin-like growth factor-2, leptin, liraglutide, luteinizing hormone, melanocortin, melanocyte-stimulating hormone, alpha-melanocyte-stimulating hormone, melanotin II, minigastrin, N-terminal prohormone of brain natriuretic peptide, nerve growth factor, neurotrophin-3, neurotrophin-4, NPH insulin, obestatin, orexin, osteocalcin, pancreatic hormone, parathyroid hormone, peptide hormone, peptide YY, plasma renin activity, pramlintide, preprohormone, prolactin, relaxin, relaxin family peptide hormone, renin, salcatonin, secretin, secretin family peptide hormone, sincalide, teleost leptins, temporin, tesamorelin, thyroid-stimulating hormone, thyrotropin-releasing hormone, urocortin, urocortin II, urocortin III, vasoactive intestinal peptide, and vitellogenin.

In some cases, the intracellular domain of a chimeric Notch receptor polypeptide of the present disclosure, when released upon binding of the first member of the specific binding pair to a second member of the specific binding pair, induces production of a growth factor in a cell that expresses the chimeric Notch polypeptide. Examples of such growth factors include, but are not limited to, hepatocyte stimulating factor, plasmacytoma growth factor, brain derived neurotrophic factor (BDNF), glial derived neurotrophic factor (GDNF), neurotrophic factor 3 (NT3), fibroblast growth factor (FGF), transforming growth factor (TGF), platelet transforming growth factor, milk growth factor, endothelial growth factors (EGF), endothelial cell-derived growth factors (ECDGF), alpha-endothelial growth factor, beta-endothelial growth factor, neurotrophic growth factor, nerve growth factor (NGF), vascular endothelial growth factor (VEGF), 4-1 BB receptor (4-1BBR), TRAIL (TNF-related apoptosis inducing ligand), artemin (GFRalpha3-RET ligand), BCA-1 (B cell-attracting chemokine1), B lymphocyte chemoattractant (BLC), B cell maturation protein (BCMA), brain-derived neurotrophic factor (BDNF), bone growth factor such as osteoprotegerin (OPG), bone-derived growth factor, megakaryocyte derived growth factor (MGDF), keratinocyte growth factor (KGF), thrombopoietin, platelet-derived growth factor (PGDF), megakaryocyte derived growth factor (MGDF), keratinocyte growth factor (KGF), platelet-derived growth factor (PGDF), neurotrophin-2 (NT-2), neurotrophin-3 (NT-3), neurotrophin-4 (NT4), neurotrophin-5 (NT-5), glial cell line-derived neurotrophic factor (GDNF), ciliary neurotrophic factor (CNTF), bone Morphogenetic protein 2 (BMP2), granulocyte macrophage colony stimulating factor (GM-CSF), granulocyte colony stimulating factor (G-CSF), macrophage colony stimulating factor (M-CSF), colony stimulating factor (CSF), and the like.

In some cases, the intracellular domain of a chimeric Notch receptor polypeptide of the present disclosure, when released upon binding of the first member of the specific binding pair to a second member of the specific binding pair, induces production of a cytokine in a cell that expresses the chimeric Notch polypeptide. Examples of such cytokines include, e.g., interferons (e.g., an alpha-interferon, a beta-interferon, a gamma-interferon); interleukins (e.g., IL-1, IL-1α, IL-2, IL-3, IL-4, IL-5, IL-6, IL-7, IL-8, IL-9, IL-10 IL-11, IL-12; IL-13, IL-14, IL-15, IL-16, IL-17, IL-17A, IL-18, IL-19, IL-20, IL-24); tumor necrosis factors (e.g., TNF-α); transforming growth factor-beta; TRAIL; and the like. Examples of such cytokines also include flexi-12 (Anderson et al. (1997) *Hum. Gene Ther.* 8:1125), a single chain polypeptide that combines the two polypeptide chains of an IL-12 heterodimer); IL-12 superkine H9 (Levin et al. (2012) *Nature* 484:529); and the like.

In some cases, the intracellular domain of a chimeric Notch receptor polypeptide of the present disclosure, when released upon binding of the first member of the specific binding pair to a second member of the specific binding pair, induces production of a chemokine in a cell that expresses the chimeric Notch polypeptide. Examples of such chemokines include, e.g., MIP-1, MIP-1β, MCP-1, RANTES, IP10, and the like. Additional examples of suitable chemokines include, but are not limited to, chemokine (C-C motif) ligand-2 (CCL2; also referred to as monocyte chemotactic protein-1 or MCP1); chemokine (C-C motif) ligand-3 (CCL3; also known as macrophage inflammatory protein-1A or MIP1A); chemokine (C-C motif) ligand-5 (CCL5; also known as RANTES); chemokine (C-C motif) ligand-17 (CCL17; also known as thymus and activation regulated chemokine or TARC); chemokine (C-C motif) ligand-19 (CCL19; also known as EBI1 ligand chemokine or ELC); chemokine (C-C motif) ligand-21 (CCL21; also known as 6Ckine); C-C chemokine receptor type 7 (CCR7); chemokine (C-X-C motif) ligand 9 (CXCL9; also known as monokine induced by gamma interferon or MIG); chemokine (C-X-C motif) ligand 10 (CXCL10; also known as interferon gamma-induced protein 10 or IP-10); chemokine (C-X-C motif) ligand 11 (CXCL11; also called interferon-inducible T-cell alpha chemoattractant or I-TAC); chemokine (C-X-C motif) ligand 16 (CXCL16; chemokine (C motif) ligand (XCL1; also known as lymphotactin); and macrophage colony-stimulating factor (MCSF).

In some cases, the intracellular domain of a binding triggered transcriptional switch, e.g., a chimeric Notch receptor polypeptide, of the present disclosure, when released upon binding of the first member of the specific binding pair to a second member of the specific binding pair, induces production of an antibody in a cell that expresses the chimeric Notch polypeptide. Such antibodies include, e.g., Natalizumab (Tysabri; Biogen Idec/Elan) targeting α4 subunit of α4β1 and α4β7 integrins (as used in the treatment of MS and Crohn's disease); Vedolizumab (MLN2; Millennium Pharmaceuticals/Takeda) targeting α4β7 integrin (as used in the treatment of UC and Crohn's disease); Belimumab (Benlysta; Human Genome Sciences/GlaxoSmithKline) targeting BAFF (as used in the treatment of SLE); Atacicept (TACI-Ig; Merck/Serono) targeting BAFF and APRIL (as used in the treatment of SLE); Alefacept (Amevive; Astellas) targeting CD2 (as used in the treatment of Plaque psoriasis, GVHD); Otelixizumab (TRX4; Tolerx/GlaxoSmithKline) targeting CD3 (as used in the treatment of T1D); Teplizumab (MGA031; MacroGenics/Eli Lilly) targeting CD3 (as used in the treatment of T1D); Rituximab (Rituxan/Mabthera; Genentech/Roche/Biogen Idec) targeting CD20 (as used in the treatment of Non-Hodgkin's lymphoma, RA (in patients with inadequate responses to TNF blockade) and CLL); Ofatumumab (Arzerra; Genmab/GlaxoSmithKline) targeting CD20 (as used in the treatment of CLL, RA); Ocrelizumab (2H7; Genentech/Roche/Biogen Idec) targeting CD20 (as used in the treatment of RA and SLE); Epratuzumab (hLL2; Immunomedics/UCB) targeting CD22 (as used in the treatment of SLE and non-Hodgkin's lymphoma); Alemtuzumab (Campath/MabCampath; Genzyme/Bayer) targeting CD52 (as used in the treatment of CLL, MS); Abatacept (Orencia; Bristol-Myers Squibb) targeting CD80 and CD86 (as used in the treatment of RA and JIA, UC and Crohn's disease, SLE); Eculizumab (Soliris; Alexion pharmaceuticals) targeting C5 complement protein (as used in the treatment of Paroxysmal nocturnal haemoglobinuria); Omalizumab (Xolair; Genentech/Roche/Novartis) targeting IgE (as used in the treatment of Moderate to severe persistent allergic asthma); Canakinumab (Ilaris; Novartis) targeting IL-1β (as used in the treatment of Cryopyrin-associated periodic syndromes, Systemic JIA, neonatal-onset multisystem inflammatory disease and acute gout); Mepolizumab (Bosatria; GlaxoSmithKline) targeting IL-5 (as used in the treatment of Hyper-eosinophilic syndrome); Reslizumab (SCH55700; Ception Therapeutics) targeting IL-5 (as used in the treatment of Eosinophilic oesophagitis); Tocilizumab (Actemra/RoActemra; Chugai/Roche) targeting IL-6R (as used in the treatment of RA, JIA); Ustekinumab (Stelara; Centocor) targeting IL-12 and IL-23 (as used in the treatment of Plaque psoriasis, Psoriatic arthritis, Crohn's disease); Briakinumab (ABT-874; Abbott) targeting IL-12 and IL-23 (as used in the treatment of Psoriasis and plaque psoriasis); Etanercept (Enbrel; Amgen/Pfizer) targeting TNF (as used in the treatment of RA, JIA, psoriatic arthritis, AS and plaque psoriasis); Infliximab (Remicade; Centocor/Merck) targeting TNF (as used in the treatment of Crohn's disease, RA, psoriatic arthritis, UC, AS and plaque psoriasis); Adalimumab (Humira/Trudexa; Abbott) targeting TNF (as used in the treatment of RA, JIA, psoriatic arthritis, Crohn's disease, AS and plaque psoriasis); Certolizumab pegol (Cimzia; UCB) targeting TNF (as used in the treatment of Crohn's disease and RA); Golimumab (Simponi; Centocor) targeting TNF (as used in the treatment of RA, psoriatic arthritis and AS); and the like. In some cases, the antibody whose production is induced by the intracellular domain of a synNotch polypeptide of the present disclosure is a therapeutic antibody for the treatment of cancer. Such antibodies include, e.g., Ipilimumab targeting CTLA-4 (as used in the treatment of Melanoma, Prostate Cancer, RCC); Tremelimumab targeting CTLA-4 (as used in the treatment of CRC, Gastric, Melanoma, NSCLC); Nivolumab targeting PD-1 (as used in the treatment of Melanoma, NSCLC, RCC); MK-3475 targeting PD-1 (as used in the treatment of Melanoma); Pidilizumab targeting PD-1 (as used in the treatment of Hematologic Malignancies); BMS-936559 targeting PD-L1 (as used in the treatment of Melanoma, NSCLC, Ovarian, RCC); MEDI4736 targeting PD-L1; MPDL33280A targeting PD-L1 (as used in the treatment of Melanoma); Rituximab targeting CD20 (as used in the treatment of Non-Hodgkin's lymphoma); Ibritumomab tiuxetan and tositumomab (as used in the treatment of Lymphoma); Brentuximab vedotin targeting CD30 (as used in the treatment of Hodgkin's lymphoma); Gemtuzumab ozogamicin targeting CD33 (as used in the treatment of Acute myelogenous leukaemia); Alemtuzumab targeting CD52 (as used in the treatment of Chronic lymphocytic leukaemia); IGN101 and adecatumumab targeting EpCAM (as used in the treatment of Epithelial tumors (breast, colon and lung)); Labetuzumab targeting CEA (as used in the treatment of Breast, colon and lung tumors); huA33 targeting gpA33 (as used in the treatment of Colorectal carcinoma); Pemtumomab and oregovomab targeting Mucins (as used in the treatment of Breast, colon, lung and ovarian tumors); CC49 (minretumomab) targeting TAG-72 (as used in the treatment of Breast, colon and lung tumors); cG250 targeting CAIX (as used in the treatment of Renal cell carcinoma); J591 targeting PSMA (as used in the treatment of Prostate carcinoma); MOv18 and MORAb-003 (farletuzumab) targeting Folate-binding protein (as used in the treatment of Ovarian tumors); 3F8, ch14.18 and KW-2871 targeting Gangliosides (such as GD2, GD3 and GM2) (as used in the treatment of Neuroectodermal tumors and some epithelial tumors); hu3S193 and IgN311 targeting Le y (as used in the treatment of Breast, colon, lung and prostate tumors); Bevacizumab targeting VEGF (as used in the treatment of Tumor vasculature); IM-2C6 and CDP791 targeting VEGFR (as used in the treatment of Epithelium-derived solid tumors); Etaracizumab targeting Integrin_V_3 (as used in the treatment of Tumor vasculature); Volociximab targeting Integrin_5_1 (as used in the treatment of Tumor vasculature); Cetuximab, panitumumab, nimotuzumab and 806 targeting EGFR (as used in the treatment of Glioma, lung, breast, colon, and head and neck tumors); Trastuzumab and pertuzumab targeting ERBB2 (as used in the treatment of Breast, colon, lung, ovarian and prostate tumors); MM-121 targeting ERBB3 (as used in the treatment of Breast, colon, lung, ovarian and prostate, tumors); AMG 102, METMAB and SCH 900105 targeting MET (as used in the treatment of Breast, ovary and lung tumors); AVE1642, IMC-A12, MK-0646, R1507 and CP 751871 targeting IGF1R (as used in the treatment of Glioma, lung, breast, head and neck, prostate and thyroid cancer); KB004 and IIIA4 targeting EPHA3 (as used in the treatment of Lung, kidney and colon tumors, melanoma, glioma and haematological malignancies); Mapatumumab (HGS-ETR1) targeting TRAILR1 (as used in the treatment of Colon, lung and pancreas tumors and haematological malignancies); HGS-ETR2 and CS-1008 targeting TRAILR2; Denosumab targeting RANKL (as used in the treatment of Prostate cancer and bone metastases); Sibrotuzumab and F19 targeting FAP (as used in the treatment of Colon, breast, lung, pancreas, and head and neck tumors); 8106 targeting Tenascin (as used in the treatment of Glioma, breast and prostate tumors); Blinatumomab (Blincyto; Amgen) targeting CD3 (as used in the treatment of ALL); pembrolizumab targeting PD-1 as used in cancer immunotherapy; 9E10 antibody targeting c-Myc; and the like.

Antibodies that may be expressed, in whole or in part, as the result of activation of a binding-triggered transcriptional switch, as described herein, also include but are not limited to 8H9, Abagovomab, Abciximab, Abituzumab, Abrilumab, Actoxumab, Aducanumab, Afelimomab, Afutuzumab, Alacizumab pegol, ALD518, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab/tocilizumab, Atorolimumab, Bapineuzumab, Basiliximab, Bavituximab, Bectumomab, Begelomab, Benralizumab, Bertilimumab, Besilesomab, Bevacizumab/Ranibizumab, Bezlotoxumab, Biciromab, Bimagrumab, Bimekizumab, Bivatuzumab mertansine, Blosozumab, Bococizumab, Brentuximabvedotin, Brodalumab, Brolucizumab, Brontictuzumab, Cantuzumab mertansine, Cantuzumab ravtansine, Caplacizumab, Capromab pendetide, Carlumab, Catumaxomab, cBR96-doxorubicin immunoconjugate, Cedelizumab, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Derlotuximab biotin, Detumomab, Dinutuximab, Diridavumab, Dorlimomab aritox, Drozitumab, Duligotumab, Dupilumab, Durvalumab, Dusigitumab, Ecromeximab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Erlizumab, Ertumaxomab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gevokizumab, Girentuximab, Glembatumumab vedotin, Gomiliximab, Guselkumab, Ibalizumab, Ibalizumab, Icrucumab, Idarucizumab, Igovomab, IMAB362, Imalumab, Imciromab, Imgatuzumab, Inclacumab, Indatuximab ravtansine, Indusatumab vedotin, Inolimomab, Inotuzumab ozogamicin, Intetumumab, Iratumumab, Isatuximab, Itolizumab, Ixekizumab, Keliximab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Margetuximab, Maslimomab, Matuzumab, Mavrilimumab, Metelimumab, Milatuzumab, Minretumomab, Mirvetuximab soravtansine, Mitumomab, Mogamulizumab, Morolimumab, Morolimumab immune, Motavizumab, Moxetumomab pasudotox, Muromonab-CD3, Nacolomab tafenatox, Namilumab, Naptumomab estafenatox, Narnatumab, Nebacumab, Necitumumab, Nemolizumab, Nerelimomab, Nesvacumab, Nofetumomab merpentan, Obiltoxaximab, Obinutuzumab, Ocaratuzumab, Odulimomab, Olaratumab, Olokizumab, Onartuzumab, Ontuxizumab, Opicinumab, Oportuzumab monatox, Orticumab, Otlertuzumab, Oxelumab, Ozanezumab, Ozoralizumab, Pagibaximab, Palivizumab, Pankomab, Panobacumab, Parsatuzumab, Pascolizumab, Pasotuxizumab, Pateclizumab, Patritumab, Perakizumab, Pexelizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Rilotumumab, Rinucumab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teprotumumab, Tesidolumab, Tetulomab, TGN1412, Ticilimumab/tremelimumab, Tigatuzumab, Tildrakizumab, TNX-650, Toralizumab, Tosatoxumab, Tovetumab, Tralokinumab, TRBS07, Tregalizumab, Trevogrumab, Tucotuzumab celmoleukin, Tuvirumab, Ublituximab, Ulocuplumab, Urelumab, Urtoxazumab, Vandortuzumab vedotin, Vantictumab, Vanucizumab, Vapaliximab, Varlilumab, Vatelizumab, Veltuzumab, Vepalimomab, Vesencumab, Visilizumab, Vorsetuzumab mafodotin, Votumumab, Zalutumumab, Zanolimumab, Zatuximab, Ziralimumab, Zolimomab aritox, and the like.

In some cases, the intracellular domain of a chimeric Notch receptor polypeptide of the present disclosure, when released upon binding of the first member of the specific binding pair to a second member of the specific binding pair, induces production of a neuropeptide in a cell that expresses the chimeric Notch polypeptide. Examples of such neuropeptides include, but are not limited to, N-Acetylaspartylglutamic acid, agouti-related peptide, alpha-endorphin, big dynorphin, bombesin, bombesin-like peptides, carbetocin, cocaine-and-amphetamine regulated transcript (CART), cholecystokinin, corazonin, corticotropin-like intermediate peptide, cortistatin, demoxytocin, dynorphin A, dynorphin B, eledoisin, enkephalin, galanin, galanin-like peptide, galmic, galnon, gamma-endorphin, ghrelin, hemopressin, kisspeptin, neurokinin B, neuromedin B, neuromedin N, neuromedin S, neuromedin U, neuromedin S, neuromedin Y, neuropeptide Y, neurotensin, nociceptin, opiorphin, orexin, orexin-A, oxytocin, physalaemin, preprotachykinin, proctolin, proenkephalin, poopiomelanocortin, protein episteme, relaxin-3, somatostatin, substance P, TAC1, tachykinin peptides, vasopressin, and vasotocin.

In some cases, the intracellular domain of a chimeric Notch receptor polypeptide of the present disclosure, when released upon binding of the first member of the specific binding pair to a second member of the specific binding pair, induces production of a transcriptional regulator (e.g., a transcription factor; a transcription inducer; a transcription repressor) in a cell that expresses the chimeric Notch polypeptide. Examples of transcriptional regulators include, e.g., ABT1, ACYP2, AEBP1, AEBP2, AES, AFF1, AFF3, AHR, ANK1, ANK2, ANKFY1, ANKIB1, ANKRD1, ANKRD10, ANKRD2, ANKRD32, ANKRD46, ANKRD49, ANKRD56, ANKRD57, ANKS4B, AR, ARHGAP17, ARID1A, ARID1B, ARID3A, ARID4A, ARID5B, ARNT, ARNT2, ARNTL, ARNTL2, ARX, ASB10, ASB11, ASB12, ASB15, ASB2, ASB5, ASB8, ASB9, ASH1L, ASH2L, ASXL1, ASZ1, ATF1, ATF3, ATF4, ATF4, ATF5, ATF6, ATF7, ATF7IP, ATM, ATOH1, ATXN3, 1300003B13RIK, B3GAT3, B930041F14RIK, BACH1, BACH2, BARX1, BARX2, BATF, BATF2, BATF3, BAZ2A, BBX, BC003267, BCL11A, BCL11B, BCL3, BCL6, BCL6B, BCLAF1, BCOR, BHLHA15, BHLHE40, BHLHE41, BLZF1, BMYC, BNC1, BNC2, BPNT1, BRCA1, BRWD1, BTBD11, BTF3, 6030408C04RIK, CAMK4, CARHSP1, CARM1, CBX4, CBX7, CCNC, CCNH, CCNT1, CCNT2, CDC5L, CDK2, CDK4, CDK9, CDKN2C, CDX1, CDX1, CDX2, CEBPA, CEBPB, CEBPD, CEBPG, CEBPG, CEBPZ, CHD4, CHD7, CHGB, CIC, CIITA, CITED1, CITED2, CITED4, CLOCK, CLPB, CML3, CNOT7, COPS2, CREB1, CREB3, CREB3L1, CREB3L1, CREB3L2, CREB3L3, CREB5, CREBBP, CREBL2, CREM, CSDA, CSDA, CSDC2, CSDE1, CTBP2, CTCF, CTCFL, CTNNB1, CTNNBL1, CXXC1, D11BWG0517E, 2300002D11RIK, DACH1, DAXX, DBP, DDIT3, DDX20, DDX54, DDX58, DEAF1, DEK, DIDO1, DLX2, DMRT1, DMRT2, DMRTB1, DNMT1, DNMT3A, DR1, DRG1, DUSP26, DYSFIP1, E2F1, E2F2, E2F3, E2F5, E2F6, EBF1, EBF2, EBF3, EBF3, EED, EGR1, EGR2, EGR3, EHF, EHMT2, EID2, ELAVL2, ELF1, ELF1, ELF2, ELF3, ELF4, ELF5, ELK3, ELK4, ELL2, EMX2, EMX2, EN2, ENPP2, EOMES, EP300, EPAS1, ERF, ERG, ESR1, ESRRA, ESRRB, ESRRG, ETS1, ETS2, ETV1, ETV3, ETV4, ETV5, ETV6, EVI1, EWSR1, EZH1, EZH2, FAH, FBXL10, FBXL11, FBXW7, FEM1A, FEM1B, FEM1C, FHL2, FLI1, FMNL2, FOS, FOSB, FOSL1, FOSL2, FOXA1, FOXA2, FOXA3, FOXC1, FOXD1, FOXD2, FOXD3, FOXF1, FOXF1A, FOXF2, FOXG1, FOXI1, FOXJ2, FOXJ3, FOXK1, FOXK2, FOXL1, FOXL2, FOXM1, FOXN1, FOXN2, FOXN3, FOXO1, FOXO3, FOXP1, FOXP2, FOXP3, FOXP4, FOXQ1, FUS, FUSIP1, 2810021G02RIK, GABPA, GABPB1, GARNL1, GAS7, GATA1, GATA2, GATA3, GATA4, GATA5, GATA5, GATA6, GBX2, GCDH, GCM1, GFI1, GFI1B, GLI2, GLI3, GLIS1, GLIS2, GLIS3, GLS2, GMEB1, GMEB2, GRHL1, GRHL2, GRHL3, GRLF1, GTF2A1, GTF2B, GTF2E2, GTF2F1, GTF2F2, GTF2H2, GTF2H4, GTF2I, GTF2IRD1, GTF2IRD1, GZF1, HAND2, HBP1, HCLS1, HDAC10, HDAC11, HDAC2, HDAC5, HDAC9, HELZ, HES1, HES4, HES5, HES6, HEXIM1, HEY2, HEYL, HHEX, HHEX, HIC1, HIC2, HIF1A, HIF1AN, HIPK2, HIVEP1, HIVEP2, HIVEP3, HLF, HLTF, HLX, HMBOX1, HMG20A, HMGA2, HMGB2, HMGB3, HNF1B, HNF4A, HNF4G, HOMEZ, HOXA10, HOXA11, HOXA13, HOXA2, HOXA3, HOXA4, HOXA5, HOXA6, HOXA7, HOXA9, HOXB1, HOXB2, HOXB3, HOXB4, HOXB6, HOXB7, HOXB8, HOXB9, HOXC10, HOXC10, HOXC11, HOXC5, HOXC6, HOXC8, HOXC9, HOXD8, HOXD9, HR, HSBP1, HSF2BP, HTATIP2, HTATSF1, HUWE1, 5830417I10RIK, ID1, ID2, ID3, ID3, IFNAR2, IKBKB, IKBKG, IKZF1, IKZF2, IKZF3, IKZF4, IL31RA, ILF3, ING1, ING2, ING3, ING4, INSM1, INTS12, IQWD1, IRF1, IRF1, IRF2, IRF3, IRF4, IRF5, IRF6, IRF7, IRF8, IRF8, IRX1, IRX2, IRX3, IRX4, IRX5, ISL1, ISL2, ISX, ISX, IVNS1ABP, 2810021J22RIK, JARID1A, JARID1B, JARID1C, JARID1D, JDP2, JUN, JUNB, JUND, KLF1, KLF10, KLF11, KLF12, KLF13, KLF15, KLF16, KLF2, KLF3, KLF3, KLF4, KLF5, KLF6, KLF7, KLF8, KLF9, KRR1, 6330416L07RIK, L3MBTL2, LASS2, LASS4, LASS6, LBA1, LBH, LBX1, LCOR, LDB1, LDB2, LEF1, LHX1, LHX2, LHX5, LIMD1, LIN28, LMO1, LMO4, LMX1A, LSM11, LSM4, LYL1, 9030612M13RIK, 1810007M14RIK, 3632451O06RIK, MAF, MAFA, MAFB, MAFF, MAFG, MAFK, MAGED1, MAP3K12, MAPK1, MAPK3, MAPK8, MAPK8IP1, MAX, MAZ, MBD2, MCM2, MCM4, MCM5, MCM6, MCM7, MECOM, MECP2, MED12, MED8, MEF2A, MEF2B, MEF2C, MEF2D, MEIS1, MEIS1, MEIS2, MEOX2, MESP2, MID1, MITF, MKI67IP, MKL1, MLL1, MLL3, MLLT10, MLLT3, MLX, MLXIP, MLXIPL, MNT, MNX1, MPL, MSC, MSRB2, MSX2, MTA3, MTF1, MTF2, MTPN, MXD1, MXD4, MXI1, MYB, MYBBP1A, MYBL2, MYC, MYCBP, MYCL1, MYCN, MYEF2, MYF6, MYNN, MYOCD, MYOD1, MYOG, MYST3, MYST4, MYT1L, MZF1, NAB1, NAB2, NANOG, NARG1, NCOA1, NCOA2, NCOA3, NCOR1, NCOR2, NDN, NEUROD1, NEUROD4, NEUROD6, NEUROG1, NEUROG2, NFAT5, NFATC1, NFATC2, NFATC2IP, NFATC3, NFATC3, NFATC4, NFE2, NFE2L1, NFE2L2, NFIA, NFIA, NFIB, NFIC, NFIL3, NFIX, NFKB1, NFKB2, NFKBIB, NFKBIE, NFKBIZ, NFX1, NFXL1, NFYA, NFYB, NHLH1, NKX2-2, NKX2-3, NKX2-5, NKX2-6, NKX6-2, NMI, NOTCH1, NOTCH2, NOTCH3, NOTCH4, NPAS1, NPAS2, NPAS3, NR0B1, NR0B2, NR1D1, NR1D2, NR1H3, NR1H4, NR1I2, NR1I3, NR2C1, NR2C2, NR2E3, NR2F1, NR2F2, NR2F6, NR3C1, NR3C2, NR4A1, NR4A2, NR4A2, NR4A3, NR5A1, NR5A2, NRARP, NRIP1, NRIP2, NSBP1, NSD1, NUDT12, NULL, NUPR1, 1700065O13RIK, OLIG1, OLIG2, OLIG3, ONECUT1, ONECUT2, ONECUT3, ORC2L, OSGIN1, OSR1, OSR2, OSTF1, OVOL1, OVOL2, PAPOLA, PAPOLG, PAPPA2, PATZ1, PAWR, PAX2, PAX5, PAX6, PAX7, PAX8, PAX9, PBX1, PBX2, PBX3, PBX4, PCBD1, PCGF6, PDCD11, PDLIM4, PDX1, PEG3, PER1, PFDN1, PGR, PHF1, PHF10, PHF12, PHF13, PHF14, PHF20, PHF21A, PHF5A, PHF7, PHOX2A, PHOX2B, PIAS2, PIR, PITX1, PITX2, PKNOX1, PKNOX2, PLA2G6, PLAGL1, PLAGL2, PLRG1, PML, POGK, POLR2B, POLR2E, POLR2H, POLR3E, POLR3H, POLRMT, POU1F1, POU2AF1, POU2F1, POU2F2, POU3F2, POU3F3, POU3F3, POU5F1, POU6F1, PPARA, PPARD, PPARG, PPARGC1A, PPARGC1B, PPP1R12C, PPP1R13B, PPP1R16B, PPP1R1B, PPP2R1A, PPP3CB, PQBP1, PRDM1, PRDM14, PRDM15, PRDM16, PRDM2, PRDM4, PRDM5, PRDM6, PRDM8, PREB, PRKAR1A, PRKCBP1, PROX1, PRRX1, PRRX2, PSMC5, PSMD10, PSMD9, PTF1A, PTGES2, PURB, PWP1, RAB11A, RAB11B, RAB15, RAB18, RAB1B, RAB25, RAB8A, RAB8B, RAI14, RARA, RARB, RARG, RASSF7, RB1, RBBP7, RBL1, RBM14, RBM39, RBM9, RBPJ, RBPJL, RCOR2, REL, RELA, RELB, RERE, REST, REXO4, RFC1, RFX1, RFX2, RFX3, RFX5, RFX7, RFX8, RHOX5, RHOX6, RHOX9, RIPK4, RNF12, RNF14, RNF141, RNF38, RNF4, RORA, RORA, RORB, RORC, RPS6KA4, RREB1, RSRC1, RUNX1, RUNX1T1, RUNX2, RUNX2, RUNX3, RUVBL1, RUVBL2, RXRA, RXRG, RYBP, SAFB2, SALL1, SALL1, SALL2, SALL4, SAP30, SAP30BP, SATB1, SATB2, SATB2, SCAND1, SCAP, SCRT2, SEC14L2, SERTAD1, SF1, SFPI1, SFRS5, SH3D19, SH3PXD2B, SHANK3, SHOX2, SHPRH, SIN3A, SIN3B, SIRT2, SIRT3, SIRT5, SIX1, SIX1, SIX2, SIX3, SIX4, SIX5, SKI, SMAD1, SMAD2, SMAD3, SMAD7, SMARCA1, SMARCA2, SMARCA5, SMARCB1, SMYD1, SNAI1, SNAI2, SNAPC2, SNAPC4, SNIP1, SOLH, SOX1, SOX10, SOX11, SOX12, SOX13, SOX15, SOX17, SOX18, SOX2, SOX21, SOX4, SOX5, SOX6, SOX7, SOX8, SOX9, SP1, SP110, SP140L, SP2, SP3, SP4, SP6, SP8, SPDEF, SPEN, SPI1, SPIB, SQSTM1, SREBF1, SREBF2, SREBF2, SRF, SSBP2, SSBP3, SSBP4, SSRP1, ST18, STAG1, STAT1, STAT1, STAT2, STAT3, STAT4, STAT5A, STAT5B, STAT5B, STAT6, SUB1, SUZ12, TADA2L, TAF13, TAF5, TAF5L, TAF7, TAF9, TAL1, TAL1, TARDBP, TBPL1, TBR1, TBX1, TBX10, TBX15, TBX18, TBX2, TBX2, TBX20, TBX21, TBX3, TBX4, TBX5, TBX6, TCEA1, TCEA3, TCEAL1, TCEB3, TCERG1, TCF12, TCF15, TCF19, TCF20, TCF21, TCF21, TCF3, TCF4, TCF7, TCF7L2, TCFAP2A, TCFAP2B, TCFAP2C, TCFCP2L1, TCFE2A, TCFE3, TCFEB, TCFEC, TCFL5, TEAD1, TEAD2, TEAD3, TEAD4, TEF, TFAP2A, TFAP2C, TFCP2L1, TFDP2, TFEB, TFEC, TGFB1I1, TGIF1, TGIF2, TGIF2LX, THRA, THRAP3, THRB, THRSP, TIAL1, TLE1, TLE6, TMEM131, TMPO, TNFAIP3, TOB1, TOX4, TP63, TRERF1, TRIB3, TRIM24, TRIM28, TRIM30, TRIP13, TRIP4, TRIP6, TRP53, TRP53BP1, TRP63, TRPS1, TRPS1, TSC22D1, TSC22D2, TSC22D3, TSC22D4, TSHZ1, TSHZ1, TSHZ3, TTRAP, TUB, TULP4, TWIST1, TWIST2, TYSND1, UBE2W, UBN1, UBP1, UBTF, UGP2, UHRF1, UHRF2, UNCX, USF1, USF2, UTF1, VDR, VEZF1, VGLL2, VSX1, WASL, WHSC1, WHSC2, WT1, WWP1, WWTR1, XBP1, YAF2, YY1, ZBED1, ZBED4, ZBTB1, ZBTB10, ZBTB16, ZBTB16, ZBTB17, ZBTB2, ZBTB20, ZBTB22, ZBTB25, ZBTB32, ZBTB38, ZBTB4, ZBTB43, ZBTB45, ZBTB47, ZBTB7A, ZBTB7B, ZBTB7C, ZCCHC8, ZDHHC13, ZDHHC16, ZDHHC21, ZDHHC5, ZDHHC6, ZEB2, ANK2ZEB2, ZFHX2, ZFHX3, ZFHX4, ZFP105, ZFP110, ZFP143, ZFP148, ZFP161, ZFP192, ZFP207, ZFP219, ZFP238, ZFP263, ZFP275, ZFP277, ZFP281, ZFP287, ZFP292, ZFP35, ZFP354C, ZFP36, ZFP36L1, ZFP386, ZFP407, ZFP42, ZFP423, ZFP426, ZFP445, ZFP451, ATF5ZFP451, ZFP467, ZFP52, ZFP57, ZFP592, ZFP593, ZFP597, ZFP612, ZFP637, ZFP64, ZFP647, ZFP748, ZFP810, ZFP9, ZFP91, ZFPM1, ZFPM2, ZFX, ZHX2, ZHX3, ZIC1, ZIC2, ZIC3, ZIC4, ZIC5, ZKSCAN1, ZKSCAN3, ZMYND11, ZNF143, ZNF160, ZNF175, ZNF184, ZNF192, ZNF213, ZNF217, ZNF219, ZNF22, ZNF238, ZNF24, ZNF267, ZNF273, ZNF276, ZNF280D, ZNF281, ZNF292, ZNF311, ZNF331, ZNF335, ZNF337, ZNF33B, ZNF366, ZNF394, ZNF398, ZNF41, ZNF410, ZNF415, ZNF423, ZNF436, ZNF444, ZNF445, ZNF451, ZNF460, ZNF496, ZNF498, ZNF516, ZNF521, ZNF532, ZNF536, ZNF546, ZNF552, ZNF563, ZNF576, ZNF580, ZNF596, ZNF621, ZNF628, ZNF648, ZNF649, ZNF652, ZNF655, ZNF664, ZNF668, ZNF687, ZNF692, ZNF696, ZNF697, ZNF710, ZNF80, ZNF91, ZNF92, ZNRD1, ZSCAN10, ZSCAN16, ZSCAN20, ZSCAN21, ZXDC, and ZZZ3. Additional examples of transcriptional regulators are as described above. Non-limiting examples of transcription factors (transcriptional activators; transcriptional repressors) set forth in SEQ ID Nos: 164-210. For example, a transcription factor can comprise an amino acid sequence having at least 75%, at least 80%, at least 85%, at least 90%, at least 95%, at least 98%, at least 99%, or 100%, amino acid sequence identity to the amino acid sequence set forth in SEQ ID Nos: 164-210.

Additional examples of transcriptional regulators as described above include but are not limited to transcription factors having a regulatory role in one or more immune cells (i.e., immune cell regulatory transcription factors). Suitable immune cell regulatory transcription factors include, e.g., 2210012G02Rik, Akap8l, Appl2, Arid4b, Arid5b, Ash1l, Atf7, Atm, C430014K11Rik, Chd9, Dmtf1, Fos, Foxo1, Foxp1, Hmbox1, Kdm5b, Klf2, Mga, Mll1, Mll3, Myst4, Pcgf6, Rev3l, Scml4, Scp2, Smarca2, Ssbp2, Suhw4, Tcf7, Tfdp2, Tox, Zbtb20, Zbtb44, Zeb1, Zfm1, Zfp1, Zfp319, Zfp329, Zfp35, Zfp386, Zfp445, Zfp518, Zfp652, Zfp827, Zhx2, Eomes, Arntl, Bbx, Hbp1, Jun, Mef2d, Mterfd1, Nfat5, Nfe212, Nr1d2, Phf21a, Taf4b, Trf, Zbtb25, Zfp326, Zfp451, Zfp58, Zfp672, Egr2, Ikzf2, Taf1d, Chrac1, Dnajb6, Aplp2, Batf, Bhlhe40, Fosb, Hist1h1c, Hopx, Ifih1, Ikzf3, Lass4, Lin54, Mxd1, Mxi1, Prdm1, Prf1, Rora, Rpa2, Sap30, Stat2, Stat3, Taf9b, Tbx21, Trps1, Xbp1, Zeb2, Atf3, Cenpc1, Lass6, Rb1, Zbtb41, Crem, Fosl2, Gtf2b, Irf7, Maff, Nr4a1, Nr4a2, Nr4a3, Obfc2a, Rbl2, Rel, Rybp, Sra1, Tgif1, Tnfaip3, Uhrf2, Zbtb1, Ccdc124, Csda, E2f3, Epas1, H1f0, H2afz, Hif1a, Ikzf5, Irf4, Nsbp1, Pim1, Rfc2, Swap70, Tfb1m, 2610036L11Rik, 5133400G04Rik, Apitd1, Blm, Brca1, Brip1, Cld, C79407, Cenpa, Cfl1, Clspn, Ddx1, Dscc1, E2f7, E2f8, Ercc6l, Ezh2, Fen1, Foxm1, Gen1, Gsg2, H2afx, Hdac1, Hdgf, Hells, Hist1h1e, Hist3h2a, Hjurp, Hmgb2, Hmgb3, Irf1, Irf8, Kif22, Kif4, Lig1, Lmo2, Lnp, Mbd4, Mcm2, Mcm3, Mcm4, Mcm5, Mcm6, Mcm7, Mybl2, Neil3, Nusap1, Orc6l, Pola1, Pola2, Pole, Pole2, Polh, Polr2f, Polr2j, Ppp1r8, Prim2, Psmc3ip, Rad51, Rad51c, Rad54l, Rfc3, Rfc4, Rnps1, Rpa1, Smarcc1, Spic, Ssrp1, Taf9, Tfdp1, Tmpo, Topbp1, Trdmt1, Uhrf1, Wdhd1, Whsc1, Zbp1, Zbtb32, Zfp367, Car1, Polg2, Atr, Lef1, Myc, Nucb2, Satb1, Taf1a, Ift57, Apex1, Chd7, Chtf8, Ctnnb1, Etv3, Irf9, Myb, Mybbp1a, Pms2, Preb, Sp110, Stat1, Trp53, Zfp414, App, Cdk9, Ddb1, Hsf2, Lbr, Pa2g4, Rbms1, Rfc1, Rfc5, Tada21, Tex261, Xrcc6, and the like.

In some cases, a transcription factor may be an artificial transcription factor (ATF) including but not limited to e.g., Zinc-finger-based artificial transcription factors (including e.g., those described in Sera T. Adv Drug Deliv Rev. 2009 61(7-8):513-26; Collins et al. Curr Opin Biotechnol. 2003 14(4):371-8; Onori et al. BMC Mol Biol. 2013 14:3 the disclosures of which are incorporated herein by reference in their entirety).

In some cases, the intracellular domain of a chimeric Notch receptor polypeptide of the present disclosure, when released upon binding of the first member of the specific binding pair to a second member of the specific binding pair, induces production of an immunoreceptor (e.g., an activating immunoreceptor or an inhibitory immunoreceptor) in a cell that expresses the chimeric Notch polypeptide. Examples of such immunoreceptors include activating immunoreceptors. A suitable activating immunoreceptor can comprise an immunoreceptor tyrosine-based activation motif (ITAM). An ITAM motif is $YX_1X_2L/I$, where $X_1$ and $X_2$ are independently any amino acid. A suitable immunoreceptor can comprise an ITAM motif-containing portion that is derived from a polypeptide that contains an ITAM motif. For example, a suitable immunoreceptor can comprise an ITAM motif-containing domain from any ITAM motif-containing protein. Thus, a suitable immunoreceptor need not contain the entire sequence of the entire protein from which it is derived. Examples of suitable ITAM motif-containing polypeptides include, but are not limited to: DAP12; FCER1G (Fc epsilon receptor I gamma chain); CD3D (CD3 delta); CD3E (CD3 epsilon); CD3G (CD3 gamma); CD3Z (CD3 zeta); and CD79A (antigen receptor complex-associated protein alpha chain). Further examples of suitable ITAM motif-containing polypeptides are as described above.

In some cases, the intracellular domain of a chimeric Notch receptor polypeptide of the present disclosure, when released upon binding of the first member of the specific binding pair to a second member of the specific binding pair, induces production of a T-cell surface glycoprotein CD3 delta chain (also known as CD3D; CD3-DELTA; T3D; CD3 antigen, delta subunit; CD3 delta; CD3d antigen, delta polypeptide (TiT3 complex); OKT3, delta chain; T-cell receptor T3 delta chain; T-cell surface glycoprotein CD3 delta chain; etc.) in a cell that expresses the chimeric Notch polypeptide. In some cases, the intracellular domain of a chimeric Notch receptor polypeptide of the present disclosure, when released upon binding of the first member of the specific binding pair to a second member of the specific binding pair, induces production of a T-cell surface glycoprotein CD3 epsilon chain (also known as CD3e, T-cell surface antigen T3/Leu-4 epsilon chain, T-cell surface glycoprotein CD3 epsilon chain, AI504783, CD3, CD3epsilon, T3e, etc.) in a cell that expresses the chimeric Notch polypeptide.

In some cases, the intracellular domain of a chimeric Notch receptor polypeptide of the present disclosure, when released upon binding of the first member of the specific binding pair to a second member of the specific binding pair, induces production of a co-stimulatory polypeptide in a cell that expresses the chimeric Notch polypeptide. Non-limiting examples of suitable co-stimulatory polypeptides include, but are not limited to, 4-1BB (CD137), CD28, ICOS, OX-40, BTLA, CD27, CD30, GITR, and HVEM. Further examples of suitable co-stimulatory polypeptides are as described above.

In some cases, the intracellular domain of a chimeric Notch receptor polypeptide of the present disclosure, when released upon binding of the first member of the specific binding pair to a second member of the specific binding pair, induces production of an inhibitory immunoreceptor in a cell that expresses the chimeric Notch polypeptide. An inhibitory immunoreceptor can comprise an immunoreceptor tyrosine-based inhibition motif (ITIM), an immunoreceptor tyrosine-based switch motif (ITSM), an NpxY motif, or a YXXΦ motif. Suitable inhibitor immunoreceptors include PD1; CTLA4; BTLA; CD160; KRLG-1; 2B4; Lag-3; and Tim-3. See, e.g., Odorizzi and Wherry (2012) *J. Immunol.* 188: 2957; and Baitsch et al. (2012) *PLoSOne* 7:e30852. Further examples of inhibitory immunoreceptors are as described above.

In some cases, the intracellular domain of a chimeric Notch receptor polypeptide of the present disclosure, when released upon binding of the first member of the specific binding pair to a second member of the specific binding pair, induces production of a recombinase in a cell that expresses the chimeric Notch polypeptide. Non-limiting examples of recombinases include a Cre recombinase; a Flp recombinase; a Dre recombinase; and the like. A further example of a recombinase is a FLPe recombinase (see, e.g., Akbudak and Srivastava (2011) *Mol. Biotechnol.* 49:82). A suitable recombinase is a Flpo recombinase. Further examples of recombinases are as described above.

In some cases, the intracellular domain of a chimeric Notch receptor polypeptide of the present disclosure, when released upon binding of the first member of the specific binding pair to a second member of the specific binding pair, induces production of a site-specific nuclease in a cell that expresses the chimeric Notch polypeptide. Non-limiting examples of site-specific nucleases include, but are not limited to, an RNA-guided DNA binding protein having nuclease activity, e.g., a Cas9 polypeptide; a transcription activator-like effector nuclease (TALEN); Zinc-finger nucleases; and the like. Further examples of site-specific nucleases are as described above.

In some cases, the intracellular domain of a chimeric Notch receptor polypeptide of the present disclosure, when released upon binding of the first member of the specific binding pair to a second member of the specific binding pair, induces production of an apoptosis inducer in a cell that expresses the chimeric Notch polypeptide. Non-limiting examples of apoptosis inducers are tBID polypeptides. The term "tBID" refers to the C-terminal truncated fragment of the BH3 interacting death agonist (BID) protein which results from the enzymatic cleavage of cytosolic BID (e.g., by active caspase). At an early stage of apoptosis, tBID translocates to the mitochondria and mediates the release of Cyt c therefrom. Non-limiting examples of tBID proteins include human tBID (amino acids 61-195 of the amino acid sequence provided in GenBank Accession No. CAG30275).

In some cases, the intracellular domain of a chimeric Notch receptor polypeptide of the present disclosure, when released upon binding of the first member of the specific binding pair to a second member of the specific binding pair, induces production of a binding-triggered transcriptional switch in a cell that expresses the chimeric Notch polypeptide.

In some cases, the intracellular domain of a chimeric Notch receptor polypeptide of the present disclosure, when released upon binding of the first member of the specific binding pair to a second member of the specific binding pair, induces production of a TCR in a cell that expresses the chimeric Notch polypeptide. The TCR is in some cases specific for an epitope of an antigen. Examples of such antigens include, e.g., tumor antigens; cancer cell-associated antigens; hematological malignancy antigens; solid tumor antigens; cell surface antigens (e.g., cell surface antigens targeted by a T cell receptor (TCR); intracellular antigens; and the like. Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2(HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72

(as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK).

In some cases, the intracellular domain of a chimeric Notch receptor polypeptide of the present disclosure, when released upon binding of the first member of the specific binding pair to a second member of the specific binding pair, induces production of a MESA polypeptide in a cell that expresses the chimeric Notch polypeptide. The MESA polypeptide in some cases comprises a domain that specifically binds an antigen. Examples of such antigens include, e.g., tumor antigens; cancer cell-associated antigens; hematological malignancy antigens; solid tumor antigens; cell surface antigens (e.g., cell surface antigens targeted by a T cell receptor (TCR); intracellular antigens; and the like. Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2(HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72 (as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK).

In some cases, the intracellular domain of a chimeric Notch receptor polypeptide of the present disclosure, when released upon binding of the first member of the specific binding pair to a second member of the specific binding pair, induces production of a CAR in a cell that expresses the chimeric Notch polypeptide. The CAR in some cases comprises a domain that specifically binds an antigen. Examples of such antigens include, e.g., tumor antigens; cancer cell-associated antigens; hematological malignancy antigens; solid tumor antigens; cell surface antigens (e.g., cell surface antigens targeted by a T cell receptor (TCR); intracellular antigens; and the like. Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2 (HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72 (as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK).

In some cases, the intracellular domain of a chimeric Notch receptor polypeptide (e.g., a first synNotch polypeptide) of the present disclosure, when released upon binding of the first member of the specific binding pair to a second member of the specific binding pair, induces production of a second synNotch polypeptide in a cell that expresses the chimeric Notch polypeptide. The second synNotch polypeptide in some cases comprises a domain that specifically binds an antigen. Examples of such antigens include, e.g., tumor antigens; cancer cell-associated antigens; hematological malignancy antigens; solid tumor antigens; cell surface antigens (e.g., cell surface antigens targeted by a T cell receptor (TCR); intracellular antigens; and the like. Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2(HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72 (as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK). In some cases, the first synNotch polypeptide and the second synNotch polypeptide specifically bind two different antigens.

In some cases, the intracellular domain of a chimeric Notch receptor polypeptide of the present disclosure, when released upon binding of the first member of the specific binding pair to a second member of the specific binding pair, induces production of a TANGO polypeptide in a cell that expresses the chimeric Notch polypeptide.

As the intracellular domain of a chimeric Notch receptor polypeptide of the present disclosure, when released upon binding of the first member of the specific binding pair to a second member of the specific binding pair, may induce the expression of various polypeptides as described herein, in some instances, induced expression of two or more polypeptides may generate a logic gated circuit. Such logic gated circuits may include but are not limited to e.g., "AND gates", "OR gates", "NOT gates" and combinations thereof including e.g., higher order gates including e.g., higher order AND gates, higher order OR gates, higher order NOT gates, higher order combined gates (i.e., gates using some combination of AND, OR and/or NOT gates).

"AND" gates of the present disclosure include where two or more inputs are required for propagation of a signal. For example, in some instances, an AND gate allows signaling through two or more binding-triggered transcriptional switches or portions thereof where two inputs, e.g., two antigens, are required for signaling through the two or more binding-triggered transcriptional switches or portions thereof.

"OR" gates of the present disclosure include where either of two or more inputs may allow for the propagation of a signal. For example, in some instances, an OR gate allows signaling through two or more binding-triggered transcriptional switches or portions thereof where any one input, e.g., either of two antigens, may induce the signaling output of the two or more binding-triggered transcriptional switches or portions thereof.

"NOT" gates of the present disclosure include where an input is capable of preventing the propagation of a signal. For example, in some instances, a NOT gate inhibits signaling through a binding-triggered transcriptional switch. In one embodiment, a NOT gate may include the inhibition of a binding interaction. For example, a competitive inhibitor that prevents the binding of parts of a split binding-triggered transcriptional switch may serve as a NOT gate that prevents signaling through the binding-triggered transcriptional switch. In another embodiment, a NOT gate may include functional inhibition of an element of a circuit. For example, an inhibitor that functionally prevents signaling through a binding-triggered transcriptional switch or the outcome of signaling through a binding-triggered transcriptional switch may serve as a NOT gate of a molecular circuit as described herein. As one example, an inhibitor domain, e.g., an inhibitory PD-1 domain, may serve as a NOT gate to prevent signaling through a binding-triggered transcriptional switch, e.g., that results in cell activation.

Multi-input gates may make use of a NOT gate in various different ways to prevent signaling through some other component of a circuit or turn off a cellular response when and/or where a signal activating the NOT gate (e.g., a particular negative antigen) is present. For example, an AND+NOT gate may include a binding triggered switch that positively influences a particular cellular activity in the presence of a first antigen and a binding triggered switch the negatively influences the cellular activity in the presence of a second antigen.

Figure 88:
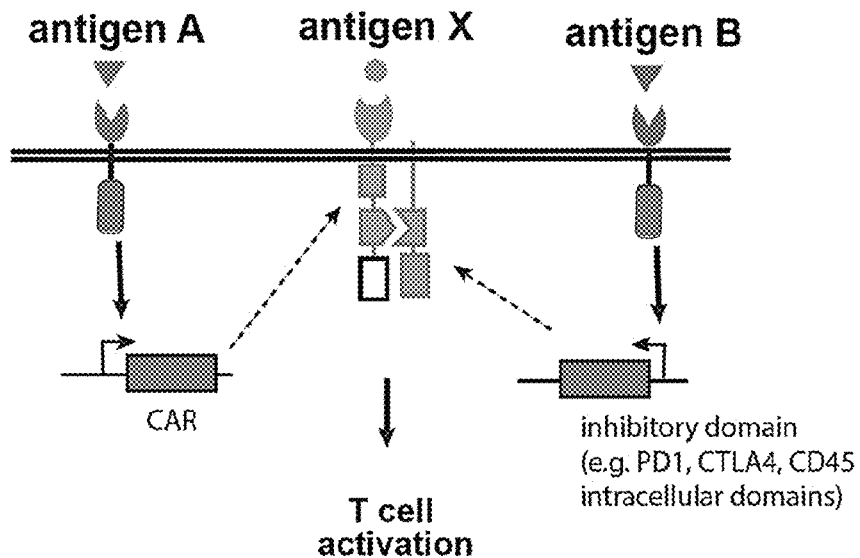
FIG. 88 provides a schematic representation of one embodiment of a three input AND+NOT gate of the present disclosure.

In one embodiment, a first binding-triggered transcriptional switch responsive to antigen A drives expression of a CAR that is responsive to antigen X such that in the presence of antigens A and X the CAR is active, resulting in T cell activation (see FIG. 88). The circuit further includes a second binding-triggered transcriptional switch that, in the presence of antigen B, represses the CAR (e.g., through an inhibitory intracellular domain (e.g., PD-1, CLTA4, CD45, etc.) preventing T cell activation (FIG. 88). Therefore, in the described embodiment of a 3 input AND+NOT gate, only when antigens A and X but not B are present is the cellular activity of T cell activation induced.

In some instances, higher order multi-input gates include a NOT gate function. For example, in a circuit where activation relies upon expression of two parts of a split transcription factor in an AND gate to induce a desired cellular activity a NOT functionality may be employed, e.g., to repress the activity of the split transcription factor.

Figure 89:
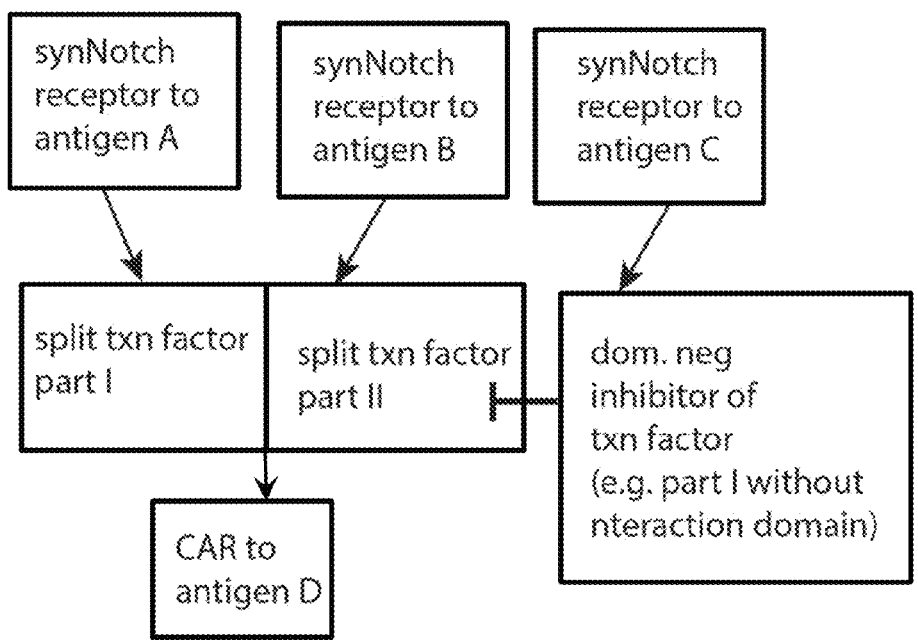
FIG. 89 provides a schematic representation of one embodiment of a multi-input gate with split transcription factor AND functionality and dominant negative NOT functionality.

In one embodiment, a first SynNotch responsive to antigen A induces the expression or releases a first part of a split transcription factor in the presence of antigen A and a second SynNotch responsive to antigen B induces the expression or releases a second part of the split transcription factor in the presence of antigen B such that when the first and second parts of the split transcription factor are present and/or free the transcription factor activates some downstream activity including, e.g., the expression of a CAR responsive to antigen D (see FIG. 89). In such an embodiment, the circuit may include a NOT functionality, e.g., in the form of a third SynNotch receptor responsive to antigen C that, in the presence of antigen C, induces or releases a dominant negative inhibitor of the split transcription factor. Any convenient dominant negative inhibitor of the transcription factor may find use in such a NOT functionality including but not limited to, e.g., a part of the split transcription factor that lacks a domain required for the two parts to form a functional transcription factor (e.g., the interaction domain) Therefore, in the described embodiment of a multi-input gate with NOT functionality (FIG. 89), only when antigens A, B and D but not C are present is the cellular activity of the CAR, e.g., T cell activation, induced.

Figure 90:
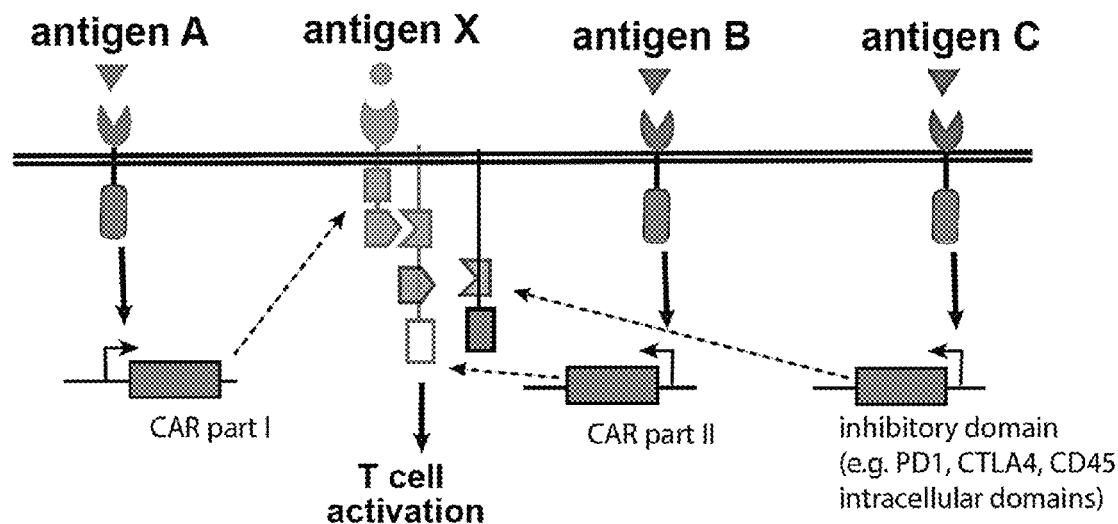
FIG. 90 provides a schematic representation of one embodiment of a multi-input gated CAR T cell activation circuit.

In another embodiment, a first SynNotch responsive to antigen A induces the expression of the first part of a split CAR responsive to antigen X and a second SynNotch responsive to antigen B induces the expression of the second part of the split CAR responsive to antigen X such that when antigens A and B are present the two parts of the split CAR form a functional CAR responsive to antigen X which results in T cell activation in the presence of antigen X (see FIG. 90). Such a circuit may further include a NOT functionality in the form of a third SynNotch responsive to antigen C such that in the presence of antigen C an intracellular inhibitory domain is expressed or released that inhibits T cell activation from the split CAR (see FIG. 90). Therefore, in the described embodiment of a four-input gate with NOT functionality (FIG. 90), only when antigens A, B and X but not C are present is the cellular activity of the gate, e.g., T cell activation through a split CAR, induced.

In some instances, a two input gated circuit may include a first SynNotch polypeptide that, when specifically bound by its respective antigen, induces the expression of a part of a split CAR. In some instances, a cell of the instant disclosure may constitutively express a first part of the split CAR and thus, upon induced expression of the second part of the split CAR the split CAR becomes responsive to its antigen when present. The necessity for the expression of the second part of a split CAR may in some instances be referred to as "priming" such that expression of the second part of the split CAR primes the system for response to the antigen to which the split CAR is responsive.

Figure 82:
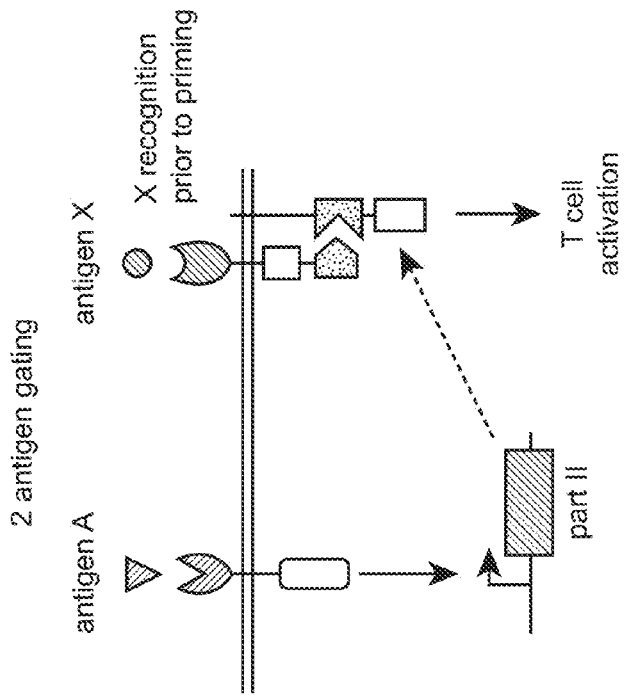
FIG. 82 depicts one embodiment of a two antigen gated split CAR circuit.

The configurations of such two antigen gated circuits may vary. In some instances, a SynNotch responsive to a first antigen (i.e., antigen A) induces the expression of a part of the split CAR containing the antigen recognition domain responsive to a second antigen (i.e., antigen X) (see e.g., FIG. 82). In such a configuration the split CAR does not recognize antigen X until the cell is primed by expression of the part of the split CAR induced by the SynNotch polypeptide. Accordingly, the presence of both antigen A and antigen X is required for T cell activation.

Figure 83:
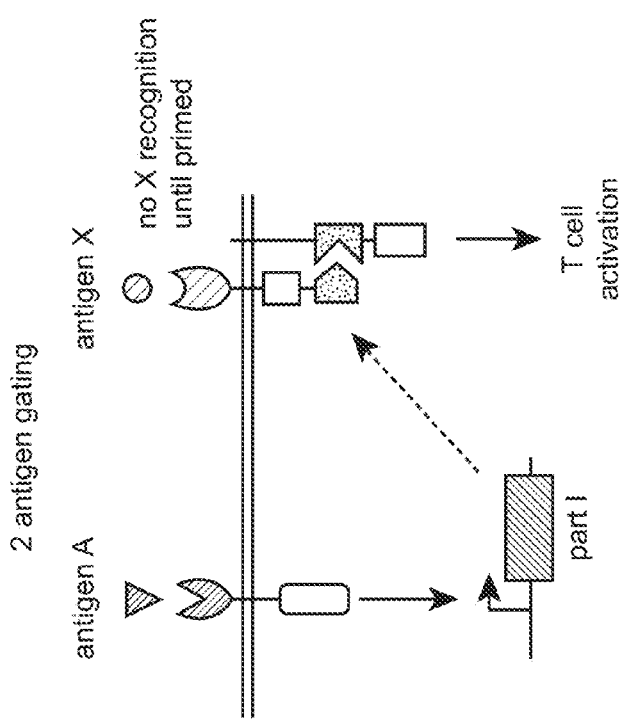
FIG. 83 depicts an additional embodiment of a two antigen gated split CAR circuit.

In some instances, a SynNotch responsive to a first antigen (i.e., antigen A) induces the expression of a part of a split CAR, responsive to a second antigen (i.e., antigen X), containing one or more intracellular components necessary for T cell activation (see e.g., FIG. 83). In such a configuration the split CAR does recognize antigen X prior to priming but, in the absence of antigen A, the binding of antigen X is not propagated to induce T cell activation. However, when the part of the split CAR induced by the SynNotch polypeptide is expressed the binding of antigen X is propagated leading to T cell activation. Accordingly, the presence of both antigen A and antigen X is required for T cell activation.

Figure 84:
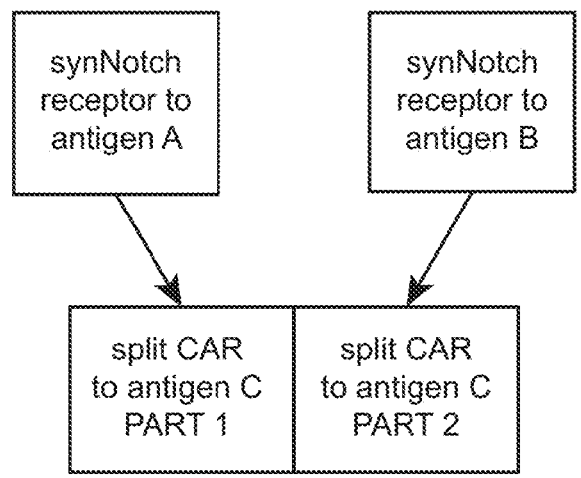
FIG. 84 provides a schematic representation of an embodiment of a three input gated circuit.
Figure 85:
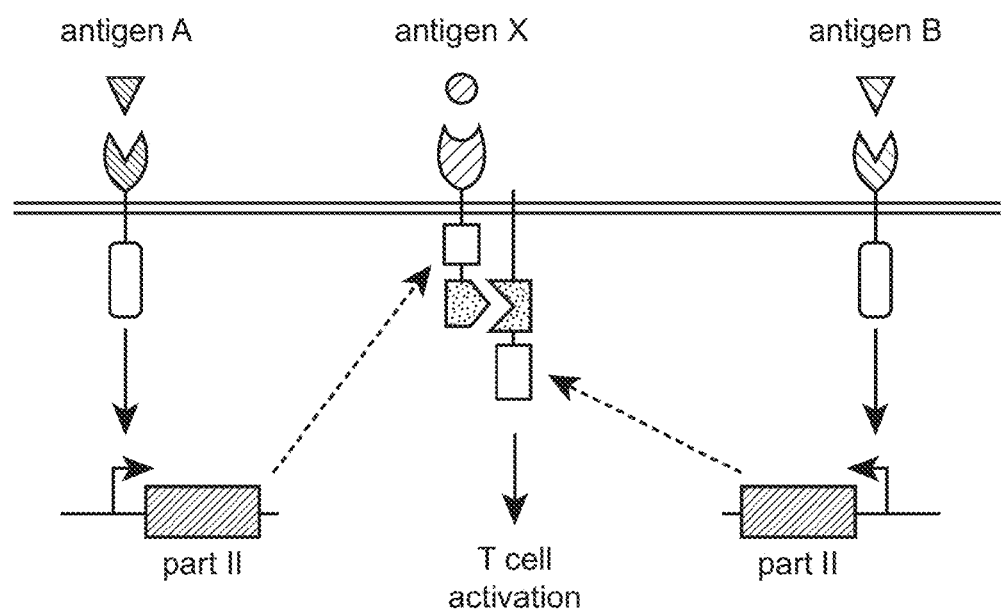
FIG. 85 provides a diagram of one configuration of a three antigen gated SynNotch, split CAR circuit.

In some instances, a three input AND gate may include two SynNotch polypeptides that, when specifically bound by their respective first and second antigens, induce expression of a third antigen-responsive polypeptide that becomes activated upon binding of a third antigen. For example, in one embodiment a three input AND gate may include a first SynNotch polypeptide responsive to a first antigen and a second SynNotch polypeptide responsive to a second antigen wherein the first and second SynNotch polypeptides induce expression of first and second parts of a split CAR that is responsive to a third antigen. Thus, in the presence of the first and second antigens (i.e., antigens A and B) the first and second parts of the split CAR are expressed and, in the presence of the third antigen (i.e., antigen C), the split CAR activates the T cell in which it is expressed (see FIG. 84). A further schematic of a three antigen gating system where two SynNotch polypeptides recognizing antigen A and antigen B induce the expression of parts of a split CAR that recognizes antigen X is depicted in FIG. 85. In such a system, antigens A, B and X are required for T cell activation.

Figure 86:
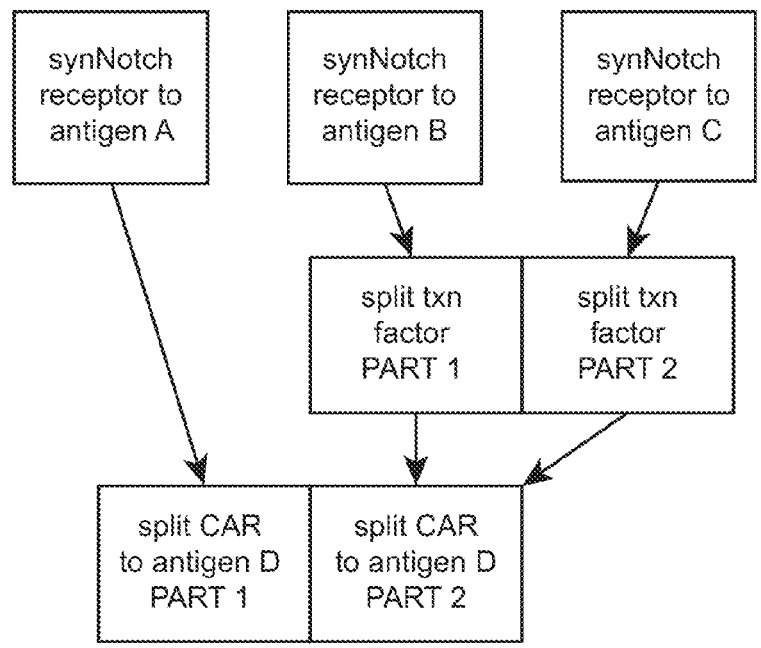
FIG. 86 provides a schematic representation of an embodiment of a four input gated circuit.

In some instances, a four input AND gate may include three SynNotch polypeptides that, when specifically bound by their respective first, second and third antigens, induce expression, directly or indirectly, of a fourth antigen-responsive polypeptide that becomes activated upon binding of a fourth antigen. For example, in one embodiment a four input AND gate may include a first SynNotch polypeptide responsive to a first antigen, a second SynNotch polypeptide responsive to a second antigen and a third SynNotch polypeptide responsive to a third antigen, wherein the first SynNotch polypeptide induces expression of a first part of a split CAR that is responsive to a fourth antigen and the second and third SynNotch polypeptides induce expression of first and second parts of a transcription factor that, when both parts are present, induce expression of the second part of the split CAR that is responsive to the fourth antigen. This, in the presence of the first, second and third antigens (i.e., antigens A, B and C) the first and second parts of the split CAR are expressed and, in the presence of the fourth antigen (i.e., antigen D), the split CAR activates the T cell in which it is expressed (see FIG. 86).

Figure 87:
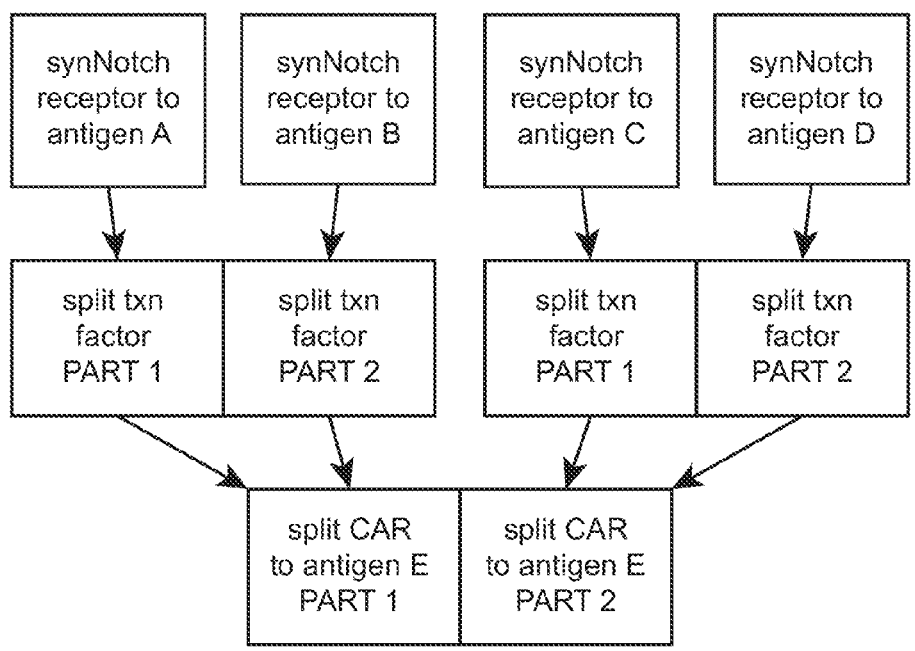
FIG. 87 provides a schematic representation of an embodiment of a five input gated circuit.

In some instances, a five input AND gate may include four SynNotch polypeptides that, when specifically bound by their respective first, second, third and fourth antigens, induce expression of a fifth antigen-responsive polypeptide that becomes activated upon binding of a fifth antigen. For example, in one embodiment a five input AND gate may include first and second SynNotch polypeptides, responsive to first and second antigens, that induce expression of first and second parts of a first transcription factor that, when both parts are present, induces expression of a first part of a split CAR and third and fourth SynNotch polypeptides, responsive to third and fourth antigens, that induce expression of first and second parts of a second transcription factor that, when both parts are present, induces expression of the second part of a split CAR that is responsive to a fifth antigen. Thus, in the presence of the first, second, third and fourth antigens (i.e., antigens A, B, C and D) the first and second parts of the split CAR are expressed and, in the presence of the fifth antigen (i.e., antigen E), the split CAR activates the T cell in which it is expressed (see FIG. 87).

Where split transcription factors are utilized, e.g., as in logic gated SynNotch circuits, the transcription factor or portion thereof may be expressed within a cell from an expression cassette separate from other expression cassettes of the system, e.g., expression cassettes containing sequence encoding a SynNotch or portion thereof, sequence encoding a CAR or portion thereof, etc. Where a transcription factor or portion thereof, e.g., a portion of a split transcription factor, is contained in an expression cassette separate from other components of the circuit the transcription factor expression cassette may contain only the sequence encoding the transcription factor or portion thereof and sequence elements necessary for its expression including e.g., a promoter, an enhancer, etc. A separate transcription factor or portion thereof may or may not contain further elements that do not materially affect the expression or function of the transcription including, e.g., sequence encoding a reporter, sequence encoding a tag, etc.

In other instances, where a split transcription factor is utilized, e.g., as in logic gated SynNotch circuit, the transcription factor or portion thereof may be expressed within a cell from an expression cassette shared with other components of the system, e.g., an expression cassette encoding a SynNotch or portion thereof, an expression cassette encoding a CAR or portion thereof, etc. Sequence encoding a transcription factor or portion thereof present on an expression cassette shared with other components of the system may be independently controlled, i.e., contain expression control elements (i.e., promoters, enhancers, etc.) separate from the other system elements of the cassette, or may be simultaneously controlled with the other system elements of the expression cassette, i.e., the transcription factor and one or more of the other system elements are controlled from the same expression control elements. Where sequence encoding a transcription factor or portion thereof is simultaneously controlled with the other system elements of the expression cassette the transcription factor or portion thereof may be encoded to be attached to one or more of the other system elements.

In certain embodiments, a nucleic acid encoding a binding-triggered transcriptional switch is configured to encode a portion of split transcription factor operably linked to one or more domains of the binding-triggered transcriptional switch such that, upon activation of the binding-triggered transcriptional switch, the portion of the split transcription factor is released and available to complex with one or more other portions of the split transcription factor to form a functional transcription factor.

Accordingly, activation of one or more binding-triggered transcriptional switches may induce expression of portions of split transcription factors resulting in heterodimerization and/or complex formation of the split transcription factor portions resulting in formation of a functional transcription factor. Alternatively, activation of one or more binding-triggered transcriptional switches may result in release of split transcription factor portions from the one or more binding-triggered transcriptional switches resulting in heterodimerization and/or complex formation of the split transcription factor portions resulting in formation of a functional transcription factor. In addition, induction and release of split transcription factor portions may be combined, e.g., where activation of one or more binding-triggered transcriptional switches may induce expression of portions of split transcription factors and release of split transcription factor portions from the one or more binding-triggered transcriptional switches resulting in heterodimerization and/or complex formation of the split transcription factor portions resulting in formation of a functional transcription factor.

Logic gated systems of the instant disclosure are not limited to those specifically described and may include alternative configurations and/or higher order gates as compared to those described. For example, in some instances a logic gated system of the instant disclosure may be a two input gate, a three input gate, a four input gate, a five input gate, a six input gate, a seven input gate, an eight input gate, a nine input gate, a ten input gate or greater. Furthermore, the components of logic gated systems of the instant disclosure are not limited to SynNotch for the induction of expression of further circuit components and may include e.g., other binding-triggered transcriptional switches including but not limited to e.g., those described herein. In addition, while the foregoing examples have been described, for simplicity, in terms of induced expression of the parts of a split CAR, other split molecules including but not limited to e.g., split SynNotch polypeptides, may find use in logic gated circuits of the instant disclosure.

The present disclosure provides a method of modulating the activity of a target cell, the method comprising: a) expressing in the target cell a first synNotch polypeptide of the present disclosure, where the first synNotch polypeptide comprises an antigen-binding domain (e.g., an scFv, a nanobody, etc.) that binds a first epitope on a soluble adapter molecule (e.g., an antigen); b) contacting the target cell with: i) a second cell that expresses a second synNotch polypeptide of the present disclosure, where the second synNotch polypeptide comprising an antigen-binding domain (e.g., an scFv, a nanobody, etc.) that binds a second epitope on the soluble adapter molecule (e.g., an antigen); and ii) the soluble adapter molecule (e.g. an antigen), wherein binding of the antigen-binding domain of the first synNotch polypeptide and the antigen-binding domain of the second synNotch polypeptide to the soluble adapter molecule (e.g., an antigen) induces cleavage of the intracellular domain of the first synNotch polypeptide, thereby releasing the intracellular domain, wherein the released intracellular domain modulates an activity of the target cell. The activity of the target cell can be selected from the group consisting of: expression of a gene product of the cell, proliferation of the cell, apoptosis of the cell, non-apoptotic death of the cell, differentiation of the cell, dedifferentiation of the cell, migration of the cell, secretion of a molecule from the cell and cellular adhesion of the cell. The adaptor molecule can be a cancer-associated antigen, a pathogen-associated antigen, an antibody, and the like.

Additional Sequences

A chimeric Notch receptor polypeptide of the present disclosure can further include one or more additional polypeptides, where suitable additional polypeptides include, but are not limited to, a signal sequence; an epitope tag; an affinity domain; a nuclear localization signal (NLS); and a polypeptide that produces a detectable signal.

Signal Sequences

Signal sequences that are suitable for use in a chimeric Notch receptor polypeptide of the present disclosure include any eukaryotic signal sequence, including a naturally-occurring signal sequence, a synthetic (e.g., man-made) signal sequence, etc.

Epitope Tag

Suitable epitope tags include, but are not limited to, hemagglutinin (HA; e.g., YPYDVPDYA (SEQ ID NO:73); FLAG (e.g., DYKDDDDK (SEQ ID NO:74); c-myc (e.g., EQKLISEEDL; SEQ ID NO:75), and the like.

Affinity Domain

Affinity domains include peptide sequences that can interact with a binding partner, e.g., such as one immobilized on a solid support, useful for identification or purification. Multiple consecutive single amino acids, such as histidine, when fused to a chimeric Notch receptor polypeptide of the present disclosure, may be used for one-step purification of the recombinant chimeric polypeptide by high affinity binding to a resin column, such as nickel sepharose. Exemplary affinity domains include His5 (HHHHH) (SEQ ID NO:76), HisX6 (HHHHHH) (SEQ ID NO:77), C-myc (EQKLISEEDL) (SEQ ID NO:75), Flag (DYKDDDDK) (SEQ ID NO:74), StrepTag (WSHPQFEK) (SEQ ID NO:78), hemagglutinin, e.g., HA Tag (YPYDVPDYA) (SEQ ID NO:73), GST, thioredoxin, cellulose binding domain, RYIRS (SEQ ID NO:79), Phe-His-His-Thr (SEQ ID NO:80), chitin binding domain, S-peptide, T7 peptide, SH2 domain, C-end RNA tag, WEAAAREACCRECCARA (SEQ ID NO:81), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, S100 proteins, parvalbumin, calbindin D9K, calbindin D28K, and calretinin, inteins, biotin, streptavidin, MyoD, Id, leucine zipper sequences, and maltose binding protein.

Nuclear Localization Sequences

Suitable nuclear localization signals ("NLS"; also referred to herein as "nuclear localization sequences") include, e.g., PKKKRKV (SEQ ID NO:82); KRPAATKKAGQAKKKK (SEQ ID NO:83); MVPKKKRK (SEQ ID NO:84); MAPKKKRKVGIHGVPAA (SEQ ID NO:85); and the like. An NLS can be present at the N-terminus of a chimeric Notch receptor polypeptide of the present disclosure; near the N-terminus of a chimeric Notch receptor polypeptide of the present disclosure (e.g., within 5 amino acids, within 10 amino acids, or within 20 amino acids of the N-terminus); at the C-terminus of a chimeric Notch receptor polypeptide of the present disclosure; near the C-terminus of a chimeric Notch receptor polypeptide of the present disclosure (e.g., within 5 amino acids, within 10 amino acids, or within 20 amino acids of the C-terminus); or internally within a chimeric Notch receptor polypeptide of the present disclosure.

Detectable Signal-Producing Polypeptides

Suitable detectable signal-producing proteins include, e.g., fluorescent proteins; enzymes that catalyze a reaction that generates a detectable signal as a product; and the like.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilised EGFP (dEGFP), destabilised ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, *Renilla* GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, mPlum (Shaner et al. (2005) *Nat. Methods* 2:905-909), and the like. Any of a variety of fluorescent and colored proteins from Anthozoan species, as described in, e.g., Matz et al. (1999) *Nature Biotechnol.* 17:969-973, is suitable for use.

Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, glucose oxidase (GO), and the like.

Examples of Second Members of Specific Binding Pairs

As noted above, binding of the first member of the specific binding pair of a chimeric Notch polypeptide of the present disclosure to a second member of the specific binding pair induces cleavage of the Notch receptor polypeptide at the one or more ligand-inducible proteolytic cleavage sites, thereby releasing the intracellular domain. As noted above, the second member of the specific binding pair can be any of a variety of molecules. In some cases, a chimeric Notch polypeptide specifically binds an antigen; e.g., the second member of the specific binding pair is an antigen. Examples of such antigens include, e.g., tumor antigens; cancer cell-associated antigens; hematological malignancy antigens; solid tumor antigens; cell surface antigens (e.g., cell surface antigens targeted by a T cell receptor (TCR); intracellular antigens; and the like. Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2(HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72 (as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK).

Exemplary Embodiments

The following are non-limiting examples of a chimeric Notch receptor polypeptide of the present disclosure.

In one non-limiting embodiment, a chimeric Notch receptor polypeptide of the present disclosure comprises a Notch receptor polypeptide that comprises, in order from N-terminus to C-terminus: i) Lin Notch Repeats A-C (an LNR segment); ii) a heterodimerization domain (an HD-N segment and an HD-C segment); iii) a TM domain; and comprises an S1 proteolytic cleavage site, an S2 proteolytic cleavage site, and an S3 proteolytic cleavage site. An example of such a Notch receptor polypeptide is depicted in FIG. 16A. In FIG. 16A, Lin Notch Repeats A-C (an LNR segment) have the following amino acid sequence: PPQ-IEEACELPECQVDAGNKVCNLQCNNHACGWDGGD-CSLNFNDPWKNCTQSLQCWK YFSDGHCDSQCN-SAGCLFDGFDCQLTEGQCNPLYDQYCKDHFSDGH CDQGCNSAECE WDGLDC (SEQ ID NO:5); the heterodimerization domain (an HD-N segment and an HD-C segment) has the following amino acid sequence: AAGTLV-LVVLLPPDQLRNNSFHFLRELSHVLHTNVVFKR DAQGQQMIFPYYGHEEELR KHPIKRSTVGWATSSLL-PGTSGG RQRRELDPMDIRGSIVYLEIDNRQCVQSSSQCFQSAT DVAAFLGALASLGSLNIPYKIEAVKSEPVEPPLP (SEQ ID NO:6), where the 51 proteolytic cleavage site includes the sequence RQRR (SEQ ID NO:86), and the S2 proteolytic cleavage site includes the sequence AV; and the TM domain has the following amino acid sequence: HLMY-VAAAAFVLLFFVGCGVLLS (SEQ ID NO:7), where the S3 proteolytic cleavage site includes the sequence VLLS (SEQ ID NO:87).

In one non-limiting embodiment, a chimeric Notch receptor polypeptide of the present disclosure comprises a Notch receptor polypeptide that comprises, in order from N-terminus to C-terminus: i) an EGF repeat; ii) Lin Notch Repeats A-C (an LNR segment); iii) a heterodimerization domain (an HD-N segment and an HD-C segment); iv) a TM domain; and comprises an S1 proteolytic cleavage site, an S2 proteolytic cleavage site, and an S3 proteolytic cleavage site. An example of such a Notch receptor polypeptide is depicted in FIG. 16B. In FIG. 16B, the EGF repeat has the following amino acid sequence: PCVGSNPCYNQGT-CEPTSENPFYRCLCPAKFNGLLCH (SEQ ID NO:8); and the LNR segment, the heterodimerization domain, the TM domain, the S1 proteolytic cleavage site, the S2 proteolytic cleavage site, and the S3 proteolytic cleavage site are as depicted in FIG. 16A.

In one non-limiting embodiment, a chimeric Notch receptor polypeptide of the present disclosure comprises a Notch receptor polypeptide that comprises the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; where the Notch receptor polypeptide has a length of 56 amino acids.

In one non-limiting embodiment, a chimeric Notch receptor polypeptide of the present disclosure comprises, in order from N-terminus to C-terminus: a) an Fc receptor FcγIIIa (CD16A); b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an Fc receptor FcγIIIa (CD16A); a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 16C. The locations of S1, S2, and S3 cleavage sites are depicted in FIG. 16A. In FIG. 16C, the CD16A has the following amino acid sequence: MWQLLLPTALLLL-VSAGMRTEDLPKAVVFLEPQWYRVLEKDSVTLKCQ-GAYSPEDNST QWFHNESLISSQASSYFIDAATVDDS-GEYRCQTNLSTLSDPVQLEVHIGWLLLQAPRWV FKEEDPIHLRCHSWKNTALHKVTYLQNGKGRKYF-HHNSDFYIPKATLKDSGSYFCRGLF GSKNVSSET-VNITITQGLAVSTISSFFPPG (SEQ ID NO:88); the Notch receptor polypeptide has the amino acid sequence depicted in FIG. 16A; and the tTA transcription factor has the following amino acid sequence: MSRLDKSKVIN-SALELLNEVGIEGLTTRKLAQKLGVEQPTLY-WHVKNKRALLDALAIE MLDRHHTHFCPLE-GESWQDFLRNNAKSFRCALLSHRDGAKVHLGTR PTEKQYETLENQ LAFLCQQGFSLENALYALSAVGH-FTLGCVLEDQEHQVAKEERETPTTDSMPPLLRQAIE LFDHQGAEPAFLFGLELIICGLEKQLKCESGG-PADALDDFDLDMLPADALDDFDLDMLP ADALDD-FDLDMLPG (SEQ ID NO:69).

In one non-limiting embodiment, a chimeric Notch receptor polypeptide of the present disclosure comprises, in order from N-terminus to C-terminus: a) a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a CD19 polypeptide; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 17A. In FIG. 17A, the CD19 polypeptide has the following amino acid sequence: RPEE-PLVVKVEEGDNAVLQCLKGTSDGPTQQLTWSRE-SPLKPFLKLSLGLPGLGIHMRP LAIWLFIFNVSQQMG-GFYLCQPGPPSEKAWQPGWTVNVEGSGELFRWNV SDLGGLGCG LKNRSSEGPSSPSGKLMSPKLY-VWAKDRPEIWEGEPPCLPPRDSLNQSLSQDLT-MAPGST LWLSCGVPPDSVSRGPLSWTHVHPKGPK-SLLSLELKDDRPARDMWVMETGLLLPRATA QDAGKYYCHRGNLTMSFHLEITARPVLWHWLLRTG-GWK (SEQ ID NO:89); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 17B. In FIG. 17B, the anti-CD19 scFv has the following amino acid sequence: DIQMTQTTSSLSASLGDRVTISCRASQDISKYLNWY-QQKPDGTVKLLIYHTSRLHSGVPS RFSGSGSGTDYS-LTISNLEQEDIATYFCQQGNTLPYTFGGGT-KLEITGGGGSGGGGSGGG GSEVKLQESGPGLVAPSQSLSVTCTVSGVSLP-DYGVSWIRQPPRKGLEWLGVIWGSETT YYNSALK-SRLTIIKDNSKSQVFLKMNSLQTDDTAIYY-CAKHYYYGGSYAMDYWGQGTS VTVSS (SEQ ID NO:90); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an antibody; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 17C. In FIG. 17C, the anti-CD19 scFv has the following amino acid sequence: DIQMTQTTSSLSASLGDRVTISCRASQDISKYLNWY-QQKPDGTVKLLIYHTSRLHSGVPS RFSGSGSGTDYS-LTISNLEQEDIATYFCQQGNTLPYTFGGGT-KLEITGGGSGGGGSGGG GSEVKLQESGPGLVAPSQSLSVTCTVSGVSLP-DYGVSWIRQPPRKGLEWLGVIWGSETT YYNSALK-SRLTIIKDNSKSQVFLKMNSLQTDDTAIYY-CAKHYYYGGSYAMDYWGQGTS VTVSS (SEQ ID NO:90); the Notch receptor polypeptide includes the amino acid sequence depicted in FIG. 16B; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an antibody; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an antibody specific for a cell surface antigen, e.g., a cell surface antigen present on the surface of a cancer cell (e.g., a cancer-specific antigen); b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-mesothelin scFv; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 18. In FIG. 18, the anti-mesothelin scFv has the following amino acid sequence: GSQVQLQQSGPELEKPGASVKISCKASGYS-FTGYTMNWVKQSHGKSLEWIGLITPYNGA SSYNQK-FRGKATLTVDKSSSTAYMDLLSLTSEDSAVYFCARG-GYDGRGFDYWGQGTT VTVSSGGGGSGGGGSSGGGSDIELTQSPAIM-SASPGEKVTMTCSASSSVSYMHWYQQKS GTSP-KRWIYDTSKLASGVPGRFSGSGSGNSYSLTISSVE-AEDDATYYCQQWSKHPLTYG AGTKLEIKAS (SEQ ID NO:91); the Notch receptor polypeptide includes the amino acid sequence depicted in FIG. 16B; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an antibody specific for a transcription factor; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-myc scFv; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. Examples of such a chimeric Notch receptor polypeptide are depicted in FIGS. 19A and 19B. In FIGS. 19A and 19B, the anti-Myc scFv has the following amino acid sequence: GSQVQLQQQVQLQESGGDLVKPGGSLKLSCAAS-GFTFSHYGMSWVRQTPDKRLEWVA TIGSRGTYT-HYPDSVKGRFTISRDNDKNALYLQMNSLKSED-TAMYYCARRSEFYYYGN TYYYSAMDYWGQGASVT-VSSGGGGSGGGGSGGGGSDIVLTQSPAFLAVS-LGQRATISC RASESVDNYGFSFMNWFQQKPGQPP-KLLIYAISNRGSGVPARFSGSGSGTDFSLNIHPVE EDDPAMYFCQQTKEVPWTFGGGTKLEIK (SEQ ID NO:92); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) a nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a LaG 9 nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 20A. In FIG. 20A, the LaG 9 nanobody has the following amino acid sequence: MADVQLVES-GGGLVQAGGSLRLSCAASGRTFSTSAMGWFRQAPG-KEREFVARITWSA GYTAYSDSVKGRFTISRDKAKNT-VYLQMNSLKPEDTAVYYCASRSAGYSSSLTRREDY AYWGQGTQVTVS (SEQ ID NO:93); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) a nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a LaG 50 nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 20B. In FIG. 20B, the LaG 50 nanobody has the following amino acid sequence: MAD-VQLVESGGGLVQAGGSLRLSCAASGRTISMAAM-SWFRQAPGKEREFVAGISRSAG SAVHADSVKGR-FTISRDNTKNTLYLQMNSLKAEDTAVYYCAVRTS GFFGSIPRTGTAFD YWGQGTQVTVS (SEQ ID NO:94); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) a nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a LaG 18 nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 20C. In FIG. 20C, the LaG 18 nanobody has the following amino acid sequence: MAQVQLVESGGGLVQTGGSLKLSCTASVRTLSYY-HVGWFRQAPGKEREFVAGIHRSGE STFYADSVKGR-FTISRDNAKNTVHLQMNSLKPEDTAVYY-CAQRVRGFFGPLRSTPSWY DYWGQGTQVTVS (SEQ ID NO:95); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) a nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a LaG 16/LaG 2 nanobody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 20D. In FIG. 20D, the LaG 16/LaG 2 nanobody has the following amino acid sequence: MAQVQLVESGGRLVQAGDSLRLSCAASGRTFST-SAMAWFRQAPGREREFVAAITWTV GNTILGDSVK-GRFTISRDRAKNTVDLQMDNLEPEDTAVYYCSARSR-GYVLSVLRSVDSY DYWGQGTQVTVSGGGGSGGGGSGGGGS-MAQVQLVESGGGLVQAGGSLRLSCAASGR TFSNYAMGWFRQAPGKEREFVAAISWTGVSTYY-ADSVKGRFTISRDNDKNTVYVQMN SLIPEDTAIYY-CAAVRARSFSDTYSRVNEYDYWGQGTQVTV (SEQ ID NO:96); the Notch receptor polypeptide includes the amino acid sequence depicted in FIG. 16A; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an apoptosis regulatory protein; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) a programmed cell death protein 1 (PD-1) extracellular domain; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a tTA transcription factor. An example of such a chimeric Notch receptor polypeptide is depicted in FIG. 21. In FIG. 21, the PD1 extracellular domain has the following amino acid sequence: MQIPQAP-WPVVWAVLQLGWRPGWFLDSPDRPWNPPTFSPALL-VVTEGDATFTCSFSNT SESFVLNWYRMSPSNQTDK-LAAFPEDRSQPGQDCRFRVTQLPNGRDFHMSVV RARRND SGTYLCGAISLAPKAQIKESLRAELRVTER-RAEVPTAHPSPSPRPAGQFQEQKLISEEDL (SEQ ID NO:97); the Notch receptor polypeptide includes the amino acid sequence depicted in FIG. 16B; and the tTA transcription factor has the amino acid sequence depicted in FIG. 16C.

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is Gal4-VP64 transcriptional activator. An example of such a chimeric Notch receptor polypeptide is depicted in FIG. 22. In FIG. 22, the anti-CD19 scFv has the following amino acid sequence: DIQMTQTTSSLSASLGDRVTISCRASQDISKYLNWYQQKPDGTVKLLIYHTSRLHSGVPS RFSGSGSGTDYSLTISNLEQEDIATYFCQQGNTLPYTFGGGTKLEITGGGGSGGGGSGGG GSEVKLQESGPGLVAPSQSLSVTCTVSGVSLPDYGVSWIRQPPRKGLEWLGVIWGSETT YYNSALKSRLTIIKDNSKSQVFLKMNSLQTDDTAIYYCAKHYYYGGSYAMDYWGQGTS VTVSS (SEQ ID NO:90); the Notch receptor polypeptide includes the amino acid sequence depicted in FIG. 16A; and the Gal4-VP64 transcriptional activator has the following amino acid sequence: MKLLSSIEQACDICRLKKLKCSKEKPKCAKCLKNNWECRYSPKTKRSPLTRAHLTEVES RLERLEQLFLLIFPREDLDMILKMDSLQDIKALLTGLFVQDNVNKDAVTDRLASVETDM PLTLRQHRISATSSSEESSNKGQRQLTVSAAAGGSGGSGGSDALDDFDLDMLGSDALDD FDLDMLGSDALDDFDLDMLGSDALDDFDLDMLGS (SEQ ID NO:70).

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a DNA binding polypeptide. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a Zip(–) Gal4 DNA binding polypeptide. An example of such a chimeric Notch receptor polypeptide is depicted in FIG. 23. In FIG. 23, the anti-CD19 scFv has the amino acid sequence depicted in FIG. 22; the Notch receptor polypeptide includes the amino acid sequence depicted in FIG. 16A; and the Zip(–) Gal4 DNA binding polypeptide has the following amino acid sequence: LEIRAAFLRQRNTALRTEVAELEQEVQRLENEVSQYETRYGPLGGGKGGSGGSGGSMK LLSSIEQACDICRLKKLKCSKEKPKCAKCLKNNWECRYSPKTKRSPLTRAHLTEVESRLE RLEQLFLLIFPREDLDMILKMDSLQDIKALLTGLFVQDNVNKDAVTDRLASVETDMPLT LRQHRISATSSSEESSNKGQRQLTVSAA (SEQ ID NO:68).

In one non-limiting embodiment, a chimeric Notch receptor polypeptide of the present disclosure comprises, in order from N-terminus to C-terminus: a) an antibody; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is a transcriptional activator. In one non-limiting embodiment, a chimeric Notch receptor polypeptide of the present disclosure comprises, in order from N-terminus to C-terminus: a) an anti-mesothelin scFv; b) a Notch receptor polypeptide comprising: i) an EGF repeat; ii) an LNR segment; iii) a heterodimerization domain (an HD-N segment and an HD-C segment); and iv) a TM domain, where the Notch receptor polypeptide comprises one or more ligand-inducible proteolytic cleavage sites; and c) an intracellular domain, where the intracellular domain is VP64 Zip(+) comprising an NLS. An example of such a chimeric Notch receptor polypeptide is depicted in FIG. 24. In FIG. 24, the anti-mesothelin scFv has the following amino acid sequence: GSQVQLQQSGPELEKPGASVKISCKASGYSFTGYTMNWVKQSHGKSLEWIGLITPYNGA SSYNQKFRGKATLTVDKSSSTAYMDLLSLTSEDSAVYFCARGGYDGRG FDYWGQGTT VTVSSGGGGSGGGGSGGGGSDIELTQSPAIMSASPGEKVTMTCSASSSVSYMHWYQQKS GTSPKRWIYD (SEQ ID NO:98); the Notch receptor polypeptide includes the amino acid sequence depicted in FIG. 16B; and the VP64 Zip(+) transcriptional activator has the following amino acid sequence: PKKKRKVDALDDFDLDMLGSDALDDFDLDMLGSDALDDFDLDMLGS DALDDFDLDM LGSGGSGGSGGSLEIEAAFLERENTALETRVAELRQRVQRLRNRVSQYRTRYGPLGGGK (SEQ ID NO:99).

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a recombinase. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a recombinase. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a FLPe recombinase (see, e.g., Akbudak and Srivastava (2011) *Mol. Biotechnol.* 49:82). An example of such a chimeric Notch receptor polypeptide is depicted in FIG. 25. In FIG. 25, the anti-CD19 scFv has the amino acid sequence depicted in FIG. 22; the Notch polypeptide includes the amino acid sequence depicted in FIG. 16A; and the FLPe recombinase has the following amino acid sequence: MSQFDILCKTPPKVLVRQFVERFERPSGEKIASCAA-ELTYLCWMITHNGTAIKRATFMSY NTIISNSLSFDI-VNKSLQFKYKTQKATILEASLKKLIPAWEFTIIPYN-GQKHQSDITDIVSSL QLQFESSEEADKGNSHSKKMLKALLSEGESIWEI-TEKILNSFEYTSRFTKTKTLYQFLFLA TFINCGRF-SDIKNVDPKSFKLVQNKYLGVIIQCLVTETKTSVS-RHIYFFSARGRIDPLVYL DEFLRNSEPVLKRVNRTGNSSSNKQEYQLLKDN-LVRSYNKALKKNAPYPIFAIKNGPKS HIGRHLMTS-FLSMKGLTELTNVVGNWSDKRASAVARTTYTHQI-TAIPDHYFALVSRYY AYDPISKEMIALKDETNPIEEWQHIEQLKGSAEG-SIRYPAWNGIISQEVLDYLSSYINRRIG PVEQKLI-SEEDL (SEQ ID NO:65).

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a recombinase. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a recombinase. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a Cre recombinase comprising an NLS. An example of such a chimeric Notch receptor polypeptide is depicted in FIG. 26. In FIG. 26, the anti-CD19 scFv has the amino acid sequence depicted in FIG. 22; the Notch polypeptide includes the amino acid sequence depicted in FIG. 16A; and the Cre recombinase has the following amino acid sequence: MVP-KKKRKVSNLLTVHQNLPALPVDATSDEVRKNLMDM-FRDRQAFSEHTWKMLLSV CRSWAAWCKLNNRKW-FPAEPEDVRDYLLYLQARGLAVKTIQQHLGQLN MLHRRSGLP RPSDSNAVSLVMRRIRKENVDAGER-AKQALAFERTDFDQVRSLMENSDRCQDIRNLAF LGIAYNTLLRIAEIARIRVKDISRTDGGRMLIHIGRTK-TLVSTAGVEKALSLGVTKLVERW ISVSGVADDPN-NYLFCRVRKNGVAAPSATSQLSTRALEGIFEATHRLI-YGAKDDSGQRY LAWSGHSARVGAARDMARAGVSIPEIMQAGGWT-NVNIVMNYIRNLDSETGAMVRLLE DGD (SEQ ID NO:100), where the Cre recombinase includes an NLS (MVPKKKRK; SEQ ID NO:84).

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a regulatory factor. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a myogenic regulatory factor. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a MyoD polypeptide. An example of such a chimeric Notch receptor polypeptide is depicted in FIG. 27. In this example, MyoD is fused to a red fluorescent protein (RFP). In FIG. 27, the anti-CD19 scFv has the amino acid sequence depicted in FIG. 22; the Notch polypeptide includes the amino acid sequence depicted in FIG. 16A; and the MyoD polypeptide has the following amino acid sequence: MELLSPPLRDIDLTGPDGSLCSFETADD-FYDDPCFDSPDLRFFEDLDPRLVHMGALLKPE EHAHFPTAVHPGPGAREDEHVRAPSGHHQAGR-CLLWACKACKRKTTNADRRKAATM RERRRLSK-VNEAFETLKRCTSSNPNQRLPKVEILR-NAIRYIEGLQALLRDQDAAPPGAAA FYAPGPLPPGRGSEHYSGDSDASSPRSNCSDGM-MDYSGPPSGPRRQNGYDTAYYSEAA RESRPGK-SAAVSSLDCLSSIVERISTDSPAAPALLLADAPPESP-PGPPEGASLSDTEQGTQT PSPDAAPQCPAGSNPNAIYQVL (SEQ ID NO:72).

In one non-limiting embodiment, a chimeric Notch receptor polypeptide of the present disclosure comprises, in order from N-terminus to C-terminus: a) an antibody; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a transcription factor. In one non-limiting embodiment, a chimeric Notch receptor polypeptide of the present disclosure comprises, in order from N-terminus to C-terminus: a) an antibody specific for a cell surface antigen; b) a Notch receptor polypeptide comprising: i) an LNR segment; ii) a heterodimerization domain (an HD-N segment and an HD-C segment); and iii) a TM domain, where the Notch receptor polypeptide comprises one or more ligand-inducible proteolytic cleavage sites; and c) an intracellular domain, where the intracellular domain is a T-box-containing transcription factor. In one non-limiting embodiment, a chimeric Notch receptor polypeptide of the present disclosure comprises, in order from N-terminus to C-terminus: a) an anti-CD19 scFv; b) a Notch receptor polypeptide comprising: i) an LNR segment; ii) a heterodimerization domain (an HD-N segment and an HD-C segment); and iii) a TM domain where the Notch receptor polypeptide comprises one or more ligand-inducible proteolytic cleavage sites; and c) an intracellular domain, where the intracellular domain is a Tbx21 polypeptide (also known as Tbet (GenBank BC039739)). An example of such a chimeric Notch receptor polypeptide is depicted in FIG. 28. Tbx21 protein is a Th1 cell-specific transcription factor that controls the expression of interferon-gamma, a Th1 cytokine. In FIG. 28, the anti-CD19 scFv has the amino acid sequence depicted in FIG. 22; the Notch polypeptide includes the amino acid sequence depicted in FIG. 16A; and the Tbx21 protein has the following amino acid sequence: MGIVEPGCGDMLTGTEPMPGSDEGRAPGADPQHRYFYPEPGAQDADERRGGGSLGSPY PGGALVPAPPSRFLGAYAYPPRPQAAGFPGAGESFPPPADAEGYQPGEGYAAPDPRAGL YPGPREDYALPAGLEVSGKLRVALNNHLLWSKFNQHQTEMIITKQGRRMFPFLSFTVAG LEPTSHYRMFVDVVLVDQHHWRYQSGKWVQCGKAEGSMPGNRLYVHPDSPNTGAH WMRQEVSFGKLKLTNNKGASNNVTQMIVLQSLHKYQPRLHIVEVNDGEPEAACNASN THIFTFQETQFIAVTAYQNAEITQLKIDNNPFAKGFRENFESMYTSVDTSIPSPPGPNCQFL GGDHYSPLLPNQYPVPSRFYPDLPGQAKDVVPQAYWLGAPRDHSYEAEFRAVSMKPAF LPSAPGPTMSYYRGQEVLAPGAGWPVAPQYPPKMGPASWFRPMRTLPMEPGPGGSEGR GPEDQGPPLVWTEIAPIRPESSDSGLGEGDSKRRRVSPYPSSGDSSSPAGAPSPFDKEAEG QFYNYFPN (SEQ ID NO:71).

In one non-limiting embodiment, a chimeric Notch receptor polypeptide of the present disclosure comprises: a) an extracellular domain; b) a Notch receptor polypeptide that comprises the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; and c) an intracellular domain. In one non-limiting embodiment, a chimeric Notch receptor polypeptide of the present disclosure comprises: a) an extracellular domain; b) a Notch receptor polypeptide that comprises the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; and c) an intracellular domain, where the intracellular domain is a transcriptional activator. In one non-limiting embodiment, a chimeric Notch receptor polypeptide of the present disclosure comprises: a) an extracellular domain, where the extracellular domain is a polypeptide found on the surface of immune cells (T cells, monocytes, macrophages, and dendritic cells); b) a Notch receptor polypeptide that comprises the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; and c) an intracellular domain, where the intracellular domain is a transcriptional activator. In one non-limiting embodiment, a chimeric Notch receptor polypeptide of the present disclosure comprises: a) an extracellular domain, where the extracellular domain is a CD4 extracellular domain; b) a Notch receptor polypeptide that comprises the following amino acid sequence: IPYKIEAVKSEPVEPPLPSQL HLMYVAAAAFVLLFFVGCGVLLSRKRRRQLCIQKL (SEQ ID NO:4); where the TM domain is underlined; where the Notch receptor polypeptide comprises an S2 proteolytic cleavage site and an S3 proteolytic cleavage site; and c) an intracellular domain, where the intracellular domain is a tTA transcriptional activator. An example of such a chimeric Notch receptor polypeptide is depicted in FIG. 29.

Nucleic Acids

The present disclosure provides a nucleic acid comprising a nucleotide sequence encoding a chimeric Notch receptor polypeptide of the present disclosure. In some cases, a nucleic acid comprising a nucleotide sequence encoding a chimeric Notch receptor polypeptide of the present disclosure is contained within an expression vector. Thus, the present disclosure provides a recombinant expression vector comprising a nucleic acid comprising a nucleotide sequence encoding a chimeric Notch receptor polypeptide of the present disclosure. In some cases, the nucleotide sequence encoding a chimeric Notch receptor polypeptide of the present disclosure is operably linked to a transcriptional control element (e.g., a promoter; an enhancer; etc.). In some cases, the transcriptional control element is inducible. In some cases, the transcriptional control element is constitutive. In some cases, the promoters are functional in eukaryotic cells. In some cases, the promoters are cell type-specific promoters. In some cases, the promoters are tissue-specific promoters.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544).

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Suitable promoter and enhancer elements are known in the art. For expression in a bacterial cell, suitable promoters include, but are not limited to, lacI, lacZ, T3, T7, gpt, lambda P and trc. For expression in a eukaryotic cell, suitable promoters include, but are not limited to, light and/or heavy chain immunoglobulin gene promoter and enhancer elements; cytomegalovirus immediate early promoter; herpes simplex virus thymidine kinase promoter; early and late SV40 promoters; promoter present in long terminal repeats from a retrovirus; mouse metallothionein-I promoter; and various art-known tissue specific promoters.

Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) *Proc. Natl. Acad. Sci. USA* 90: 7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

In some cases, the promoter is a cardiomyocyte-specific promoter. In some cases, the promoter is a smooth muscle cell-specific promoter. In some cases, the promoter is a neuron-specific promoter. In some cases, the promoter is an adipocyte-specific promoter. Other cell type-specific promoters are known in the art and are suitable for use herein.

In some cases, a nucleic acid comprising a nucleotide sequence encoding a chimeric Notch receptor polypeptide of the present disclosure is a recombinant expression vector. In some embodiments, the recombinant expression vector is a viral construct, e.g., a recombinant adeno-associated virus (AAV) construct, a recombinant adenoviral construct, a recombinant lentiviral construct, a recombinant retroviral construct, etc. In some cases, a nucleic acid comprising a nucleotide sequence encoding a chimeric Notch receptor polypeptide of the present disclosure is a recombinant lentivirus vector. In some cases, a nucleic acid comprising a nucleotide sequence encoding a chimeric Notch receptor polypeptide of the present disclosure is a recombinant AAV vector.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., Hum Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, the vector is a lentivirus vector. Also suitable are transposon-mediated vectors, such as piggyback and sleeping beauty vectors.

Host Cells

The present disclosure provides host cells genetically modified with a nucleic acid of the present disclosure, i.e., host cells genetically modified with a nucleic acid comprising a nucleotide sequence encoding a chimeric Notch receptor polypeptide of the present disclosure. The present disclosure provides a method of modulating an activity of a cell that expresses a chimeric Notch polypeptide of the present disclosure. The method generally involves contacting the cell with a second member of the specific binding pair. Binding of the first member of the specific binding pair to the second member of the specific binding pair induces cleavage of the Notch receptor polypeptide at the one or more ligand-inducible proteolytic cleavage sites, thereby releasing the intracellular domain. Release of the intracellular domain modulates an activity of the cell.

In some cases, the cell is a eukaryotic cell. In some cases, the cell is a mammalian cell, an amphibian cell, a reptile cell, an avian cell, or a plant cell. In some cases, the cell is a plant cell.

In some cases, the cell is a mammalian cell. In some cases, the cell is a human cell. In some cases, the cell is a mouse cell. In some cases, the cell is rat cell. In some cases, the cell is non-human primate cell. In some cases, the cell is lagomorph cell. In some cases, the cell is an ungulate cell.

In some cases, the cell is an immune cell, e.g., a T cell, a B cell, a macrophage, a dendritic cell, a natural killer cell, a monocyte, etc. In some cases, the cell is a T cell. In some cases, the cell is a cytotoxic T cell (e.g., a CD8+ T cell). In some cases, the cell is a helper T cell (e.g., a CD4+ T cell). In some cases, the cell is a regulatory T cell ("Treg"). In some cases, the cell is a B cell. In some cases, the cell is a macrophage. In some cases, the cell is a dendritic cell. In some cases, the cell is a peripheral blood mononuclear cell. In some cases, the cell is a monocyte. In some cases, the cell is a natural killer (NK) cell. In some cases, the cell is a CD4+, FOXP3+ Treg cell. In some cases, the cell is a CD4+, FOXP3 Treg cell.

In some instances, the cell is obtained from an individual. For example, in some cases, the cell is a primary cell. As another example, the cell is a stem cell or progenitor cell obtained from an individual.

As one non-limiting example, in some cases, the cell is an immune cell obtained from an individual. As an example, the cell can be a T lymphocyte obtained from an individual. As another example, the cell is a cytotoxic cell (e.g., a cytotoxic T cell) obtained from an individual. As another example, the cell can be a helper T cell obtained from an individual. As another example, the cell can be a regulatory T cell obtained from an individual. As another example, the cell can be an NK cell obtained from an individual. As another example, the cell can be a macrophage obtained from an individual. As another example, the cell can be a dendritic cell obtained from an individual. As another example, the cell can be a B cell obtained from an individual. As another example, the cell can be a peripheral blood mononuclear cell obtained from an individual.

In some cases, the host cell is a somatic cell, e.g. a fibroblast, a hematopoietic cell, a neuron, a pancreatic cell, a muscle cell, a bone cell, a hepatocyte, a pancreatic cell, an epithelial cell, an endothelial cell, a cardiomyocyte, a T cell, a B cell, an osteocyte, and the like.

In some cases, the cell is genetically modified to express two different chimeric Notch receptor polypeptides of the present disclosure. For example, in some cases, a host cell is genetically modified to express: i) a first chimeric Notch receptor polypeptide comprising a first member of a first specific binding pair; and ii) at least a second chimeric Notch receptor polypeptide comprising a first member of a second specific binding pair, where the first and the second specific binding pairs are different from one another such that binding of a second member of the first specific binding pair to the first member of the first specific binding pair does not result in release of the intracellular domain of the second chimeric Notch receptor polypeptide, and such that binding of a second member of the second specific binding pair to the first member of the second specific binding pair does not result in release of the intracellular domain of the first second chimeric Notch receptor polypeptide.

In some cases, the cell is genetically modified to express a chimeric Notch receptor polypeptide of the present disclosure. In some cases, the cell is genetically modified to express a chimeric Notch receptor polypeptide of the present disclosure; and is further genetically modified to express a chimeric antigen receptor (CAR). For example, in some cases, the host cell is genetically modified with a nucleic acid comprising a nucleotide sequence encoding a CAR, and the intracellular domain of the chimeric polypeptide is a transcriptional activator. In some cases, the nucleotide sequence encoding the CAR is operably linked to a transcriptional control element that is activated by the intracellular domain of the chimeric polypeptide. Many CAR polypeptides have been described in the art, any of which is suitable for use herein.

In some cases, the CAR comprises an extracellular domain, a transmembrane region and an intracellular signaling domain; where the extracellular domain comprises a ligand or a receptor linked to an optional support region capable of tethering the extracellular domain to a cell surface, and the intracellular signaling domain comprises the signaling domain from the zeta chain of the human CD3 complex (CD3zeta) and one or more costimulatory signaling domains, such as those from CD28, 4-1BB and OX-40. The extracellular domain contains a recognition element (e.g., an antibody or other target-binding scaffold) that enables the CAR to bind a target. In some cases, a CAR comprises the antigen binding domains of an antibody (e.g., an scFv) linked to T-cell signaling domains. In some cases, when expressed on the surface of a T cell, the CAR can direct T cell activity to those cells expressing a receptor or ligand for which this recognition element is specific. As an example, a CAR that contains an extracellular domain that contains a recognition element specific for a tumor antigen can direct T cell activity to tumor cells that bear the tumor antigen. The intracellular region enables the cell (e.g., a T cell) to receive costimulatory signals. The costimulatory signaling domains can be selected from CD28, 4-1BB, OX-40 or any combination of these. Exemplary CARs comprise a human CD4 transmembrane region, a human IgG4 Fc and a receptor or ligand that is tumor-specific, such as an IL13 or IL3 molecule.

The extracellular domain is made up of a soluble receptor ligand (that is specific for a target tumor antigen or other tumor cell-surface molecule) linked to an optional support region capable of tethering the extracellular domain to a cell surface. In some cases, the CAR is a heterodimeric, conditionally active CAR, as described in WO 2014/127261. In some embodiments, the heterodimeric, conditionally active CAR is activated by: i) binding an antigen for which the CAR is specific; and ii) a dimerizing agent that induces dimerization of the two polypeptide chains of the heterodimeric, conditionally active CAR. The dimerizing agent can be a small molecule, or can be light.

Transgenic Organisms

The present disclosure provides non-human transgenic organisms that comprise a nucleic acid encoding a chimeric Notch polypeptide of the present disclosure. A transgenic non-human organism of the present disclosure comprises a genome that has been genetically modified to include a nucleic acid comprising a nucleotide sequence encoding a chimeric Notch polypeptide of the present disclosure.

Methods of producing genetically modified organisms are known in the art. For example, see Cho et al., Curr Protoc Cell Biol. 2009 March; Chapter 19:Unit 19.11: Generation of transgenic mice; Gama et al., Brain Struct Funct. 2010 March; 214(2-3):91-109. Epub 2009 Nov. 25: Animal transgenesis: an overview; and Husaini et al., GM Crops. 2011 June-December; 2(3):150-62. Epub 2011 Jun. 1: Approaches for gene targeting and targeted gene expression in plants.

In a non-human transgenic organism of the present disclosure, a nucleic acid comprising a nucleotide sequence encoding a chimeric Notch polypeptide of the present disclosure can be under the control of (i.e., operably linked to) an unknown promoter (e.g., when the nucleic acid randomly integrates into a host cell genome) or can be under the control of (i.e., operably linked to) a known promoter.

Suitable known promoters can be any known promoter and include constitutively active promoters (e.g., CMV promoter), inducible promoters (e.g., heat shock promoter, Tetracycline-regulated promoter, Steroid-regulated promoter, Metal-regulated promoter, estrogen receptor-regulated promoter, etc.), spatially restricted and/or temporally restricted promoters (e.g., a tissue specific promoter, a cell type specific promoter, etc.), etc.

A subject genetically modified organism (e.g. an organism whose genome comprises a nucleotide sequence encoding chimeric Notch polypeptide of the present disclosure can be any organism including for example, a plant; an invertebrate (e.g., a cnidarian, an echinoderm, a worm, a fly, etc.); a non-mammalian vertebrate (e.g., a fish (e.g., zebrafish, puffer fish, gold fish, etc.)); an amphibian (e.g., salamander, frog, etc.); a reptile; a bird; a mammal; etc.); an ungulate (e.g., a goat, a pig, a sheep, a cow, etc.); a rodent (e.g., a mouse, a rat, a hamster, a guinea pig); a lagomorph (e.g., a rabbit); etc. In some cases, the transgenic non-human organism is a mouse. In some cases, the transgenic non-human organism is a rat. In some cases, the transgenic non-human organism is a plant.

In some embodiments, the transgenic non-human animal is homozygous for the transgene encoding a chimeric Notch polypeptide of the present disclosure. In some embodiments, the transgenic non-human animal is heterozygous for the transgene encoding a chimeric Notch polypeptide of the present disclosure.

Methods

A chimeric Notch receptor polypeptide of the present disclosure, and a nucleic acid of the present disclosure (a nucleic acid comprising a nucleotide sequence encoding a chimeric Notch receptor polypeptide), and a recombinant expression vector comprising a nucleic acid of the present disclosure, are useful in a variety of applications. The present disclosure provides such applications.

The present disclosure provides a method of modulating an activity of a cell that expresses a chimeric Notch polypeptide of the present disclosure. Methods of the present disclosure for modulating the activity of a cell can be carried out in vitro, ex vivo, or in vivo. Methods of the present disclosure for modulating the activity of a cell can be carried out in a single cell, or in a multicellular environment (e.g., a naturally-occurring tissue; an artificial tissue; etc.). Methods of the present disclosure for modulating the activity of a cell can be carried out in parallel or in series.

Methods of Modulating an Activity of a Cell

The present disclosure provides a method of modulating an activity of a cell that expresses a chimeric Notch polypeptide of the present disclosure. In some cases, the method comprises: contacting the cell with a second member of the specific binding pair, wherein binding of the first member of the specific binding pair to the second member of the specific binding pair induces cleavage of the Notch receptor polypeptide at the one or more ligand-inducible proteolytic cleavage sites, thereby releasing the intracellular domain, wherein release of the intracellular domain modulates the activity of the cell. The intracellular domain provides an "effector function," where an effector function can be transcriptional activation; transcriptional repression; translational activation; translational repression; modulation of organelle function; immune cell activation; immune cell repression; induction of apoptosis; repression of apoptosis; nuclease activity; regulation of differentiation; replacement of a target nucleic acid; modification of a target nucleic acid; etc. Activities of a cell that can be modulated using a method of the present disclosure include, but are not limited to, immune cell activation (e.g., T cell activation, etc.); apoptosis; production of effector molecules (e.g., cytokines, antibodies, growth factors, etc.); transcription of a target nucleic acid; translation of a target mRNA; organelle activity; intracellular trafficking; differentiation; and the like. The methods of the present disclosure can also be used to cause the release of effectors that act at the plasma membrane, thereby leading to modification of cellular activity (e.g. release of immune co-inhibitory receptor motifs that provide for immune activation).

The present disclosure provides a method of inducing an effector function in a cell that expresses a chimeric Notch polypeptide of the present disclosure. In some cases, the method comprises: contacting the cell with a second member of the specific binding pair, wherein binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain provides an effector function, wherein release of the intracellular domain provides for action of the effector function in the cell.

In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is an apoptosis inducer. In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a recombinase. In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a Cas9 polypeptide. In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a dCas9 polypeptide. In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a transcriptional activator. In some cases, binding of the first member of the specific binding pair to the second member of the specific binding pair induces cleavage of the Notch receptor polypeptide at the one or more ligand-inducible proteolytic cleavage sites, thereby releasing the intracellular domain, wherein the intracellular domain is a transcription repressor.

The methods of the present disclosure can be carried out in vivo, in vitro, or ex vivo.

In some cases, a method of the present disclosure is carried out ex vivo, where cells are obtained from an individual, and genetically modified to express: i) a single chimeric Notch receptor polypeptide of the present disclosure; ii) two or more chimeric Notch receptor polypeptides of the present disclosure; iii) a chimeric Notch receptor polypeptide of the present disclosure and a CAR; or iv) a chimeric Notch receptor polypeptide of the present disclosure and a naturally-occurring or synthetic receptor that provides for a non-endogenous responsive capability in the cell.

As one non-limiting example, the present disclosure provides a method of treating cancer in an individual having a cancer, the method comprising: i) genetically modifying T lymphocytes or natural killer (NK) cells obtained from the individual with an expression vector comprising a nucleotide sequence encoding a chimeric Notch receptor polypeptide of the present disclosure, where the chimeric Notch receptor polypeptide is specific for an epitope on a cancer cell in the individual, and where the genetic modification is carried out ex vivo; ii) introducing the genetically modified T lymphocytes or NK cells into the individual, where the genetically modified T lymphocytes or NK recognize and kill the cancer cell, thereby treating the cancer.

In some cases, a method of the present disclosure is carried out in vivo, e.g., where an expression vector comprising a nucleotide sequence encoding a chimeric Notch receptor polypeptide of the present disclosure is administered to an individual in need thereof. Methods of administering an expression vector to an individual are well known in the art; any known method for administering an expression vector to an individual is suitable for use in a method of the present disclosure.

In some cases, a method of the present disclosure is carried out in vitro, e.g., in in vitro cell culture, with cells grown as single cells in suspension, with cells grown on a solid support, with cells grown in a 3-dimensional scaffold, and the like.

Direct Control of Effector Function

The present disclosure provides a method of modulating an activity of a cell that expresses a chimeric Notch polypeptide of the present disclosure. As described in detail above, the chimeric Notch polypeptide comprises an extracellular domain that comprises a first member of a specific binding pair. The chimeric Notch polypeptide also comprises a Notch receptor polypeptide comprising one or more ligand-inducible proteolytic cleavage sites; and an intracellular domain. In some cases, the method comprises contacting the cell with a second member of the specific binding pair, where binding of the first member of the specific binding pair to the second member of the specific binding pair induces cleavage of the Notch receptor polypeptide at the one or more ligand-inducible proteolytic cleavage sites, thereby releasing the intracellular domain, wherein release of the intracellular domain modulates the activity of the cell. In some cases, the second member of the specific binding pair is present on the cell surface of a second cell that contacts the cell that expresses a chimeric Notch polypeptide of the present disclosure. In some cases, the second member of the specific binding pair is soluble.

Figure 5:
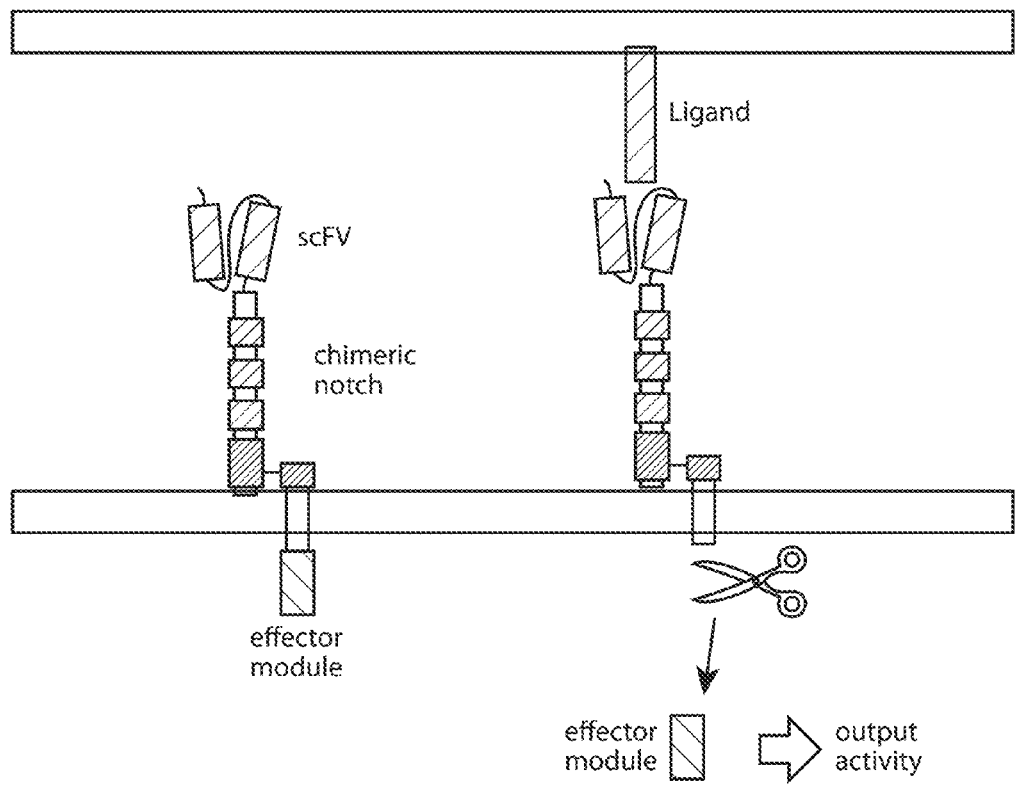
FIG. 5 provides a schematic depiction of direct control of effector function, using a chimeric Notch receptor polypeptide of the present disclosure.

In some cases, the released intracellular domain directly modulates the cell that expresses a chimeric Notch polypeptide of the present disclosure. Such an embodiment is illustrated schematically in FIG. 5.

Figure 6:
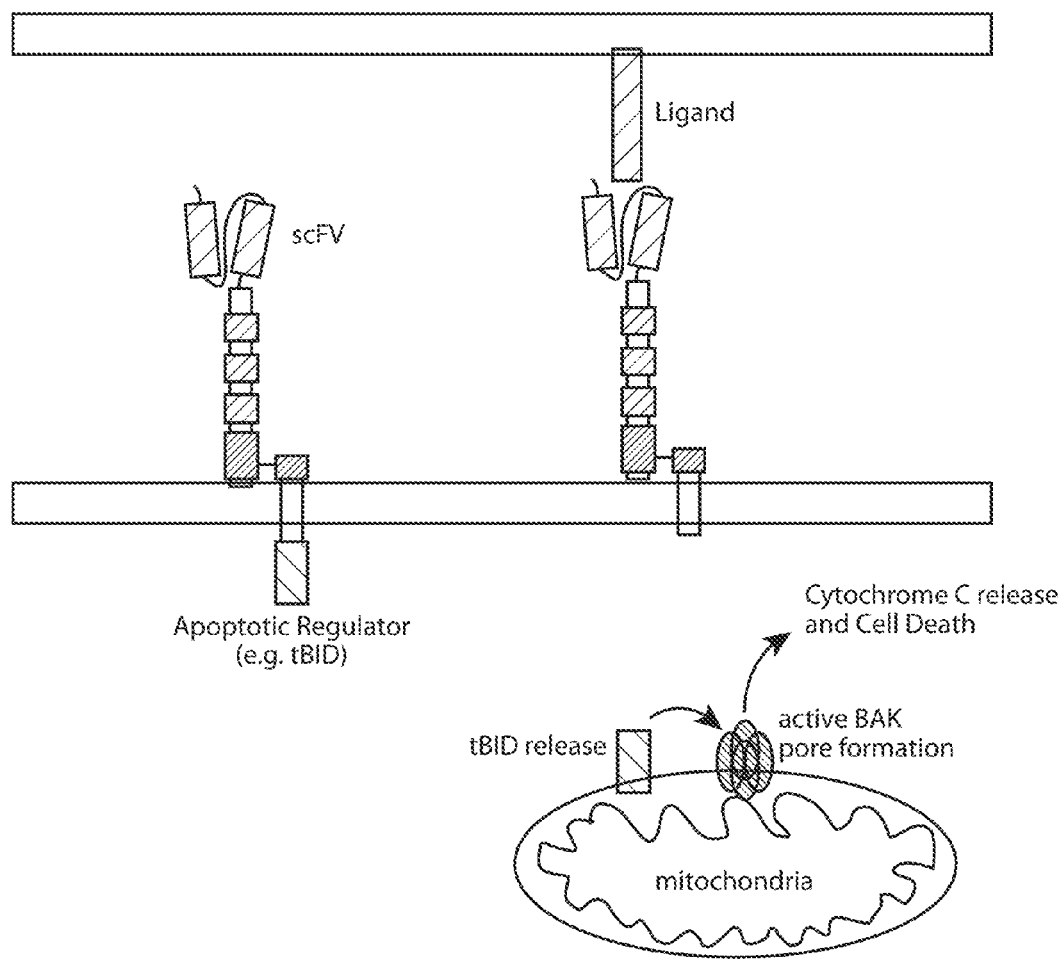
FIG. 6 provides a schematic depiction of an example of direct control of effector function, using a chimeric Notch receptor polypeptide of the present disclosure.

As a non-limiting example of a direct control of effector function, a chimeric Notch receptor polypeptide of the present disclosure comprises an extracellular domain comprising a scFv specific for a ligand, and an apoptotic regulator (e.g., tBID) as the intracellular domain. The chimeric Notch receptor polypeptide is expressed on the surface of a first cell. Upon binding to a second member of the specific binding pair (which in this case is a ligand (antigen) specifically bound by the scFv) on the surface of a second cell, the tBID is released in the first cell and induces apoptosis in the first cell. This example is illustrated schematically in FIG. 6.

Indirect Control of Effector Function

The present disclosure provides a method of modulating an activity of a cell that expresses a chimeric Notch polypeptide of the present disclosure. As described in detail above, the chimeric Notch polypeptide comprises an extracellular domain that comprises a first member of a specific binding pair. The chimeric Notch polypeptide also comprises a Notch receptor polypeptide comprising one or more ligand-inducible proteolytic cleavage sites; and an intracellular domain. In some cases, the method comprises contacting the cell with a second member of the specific binding pair, where binding of the first member of the specific binding pair to the second member of the specific binding pair induces cleavage of the Notch receptor polypeptide at the one or more ligand-inducible proteolytic cleavage sites, thereby releasing the intracellular domain. In some cases, the second member of the specific binding pair is present on the cell surface of a second cell that contacts the cell that expresses a chimeric Notch polypeptide of the present disclosure. In some cases, the second member of the specific binding pair is soluble.

Figure 7:
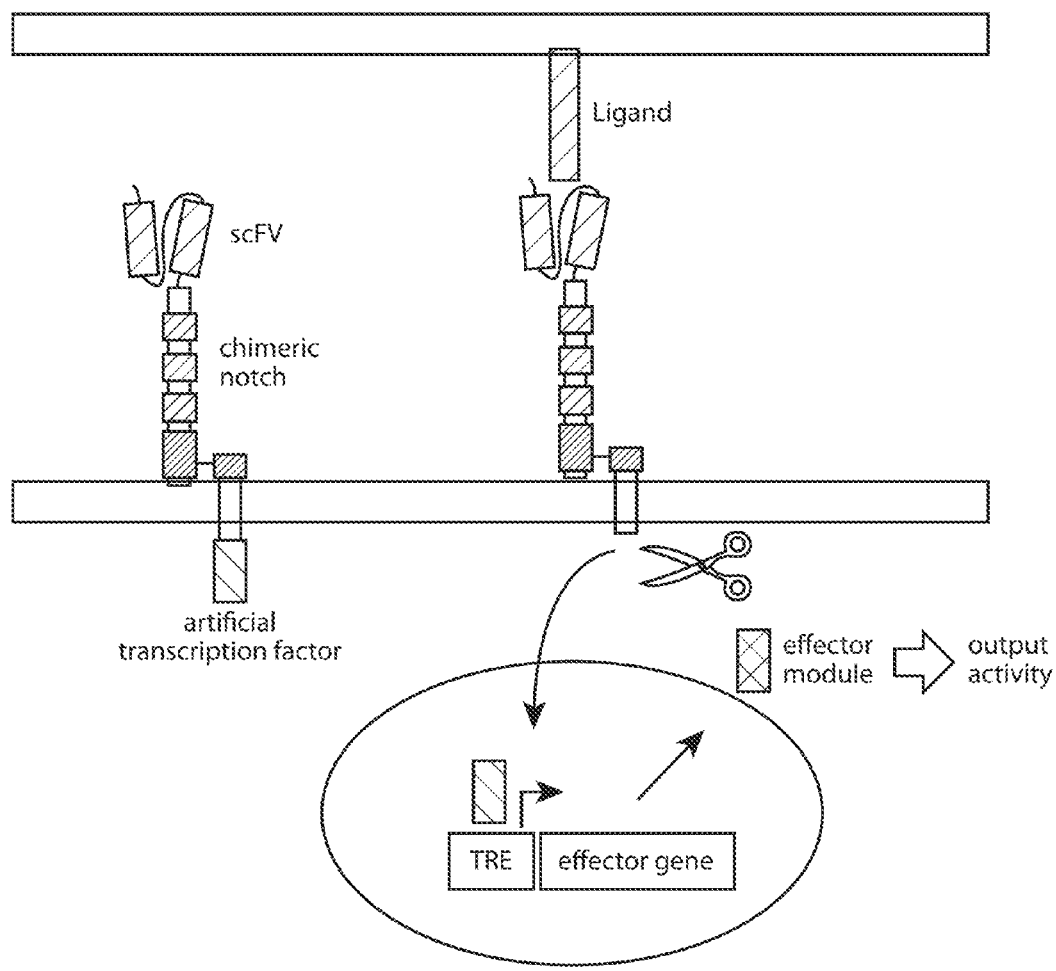
FIG. 7 provides a schematic depiction of indirect control of effector function, using a chimeric Notch receptor polypeptide of the present disclosure.

In some cases, the released intracellular domain is a transcription factor or a translation factor that, when released, regulates expression (e.g., increases transcription; decreases transcription; increase translation; decreases translation; etc.) of a target nucleic acid. In some cases, the released intracellular domain is a transcription factor that, when released, induces transcription of an effector gene, resulting in production of a gene product (e.g., an effector polypeptide; an effector nucleic acid) encoded by the effector gene. An example of such an "indirect" control of effector function is depicted in FIG. 7. In some cases, the effector polypeptide is an apoptosis inducer, an activating immunoreceptor, an inhibiting immunoreceptor, a transcription factor, an apoptosis inhibitor, a secreted factor (e.g., a cytokine; a hormone; a chemokine; an antibody; a receptor that alters the ability of the cell to respond to one or more endogenous factors; a dominant negative regulatory protein; an intracellular blocking protein; etc.) or a site-specific nuclease. In some cases, the released intracellular domain is a polypeptide that, when released, modulates (increases or decreases) translation, mRNA stability, or protein processing, of a target gene product, where the target gene product provides an effector function.

Figure 8:
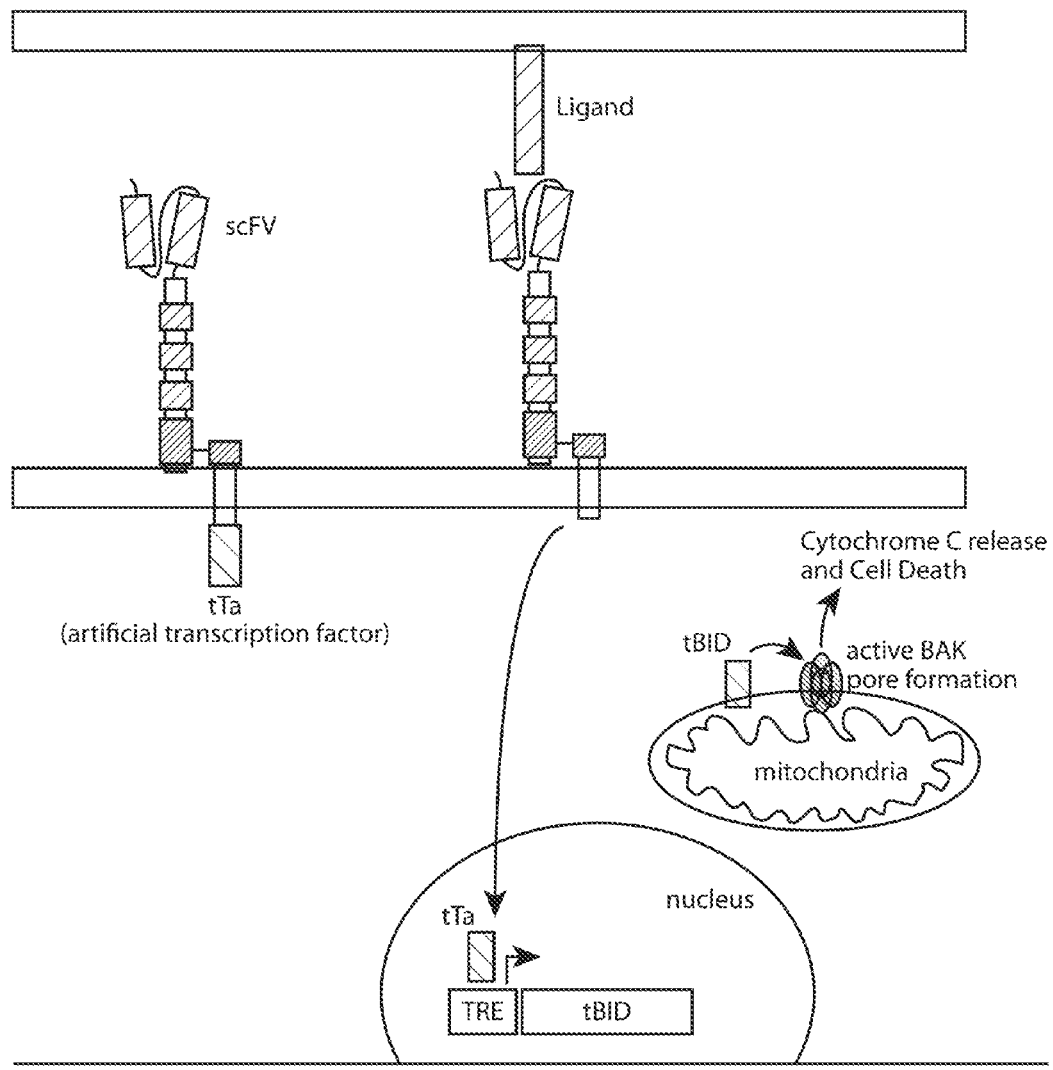
FIG. 8 provides a schematic depiction of an example of indirect control of effector function, using a chimeric Notch receptor polypeptide of the present disclosure.

As a non-limiting example of indirect control of effector function, a chimeric Notch receptor polypeptide of the present disclosure comprises an extracellular domain comprising a scFv specific for a ligand, and an intracellular domain comprising a transcription factor (e.g., tTa). The chimeric Notch receptor polypeptide is expressed on the surface of a first cell. Upon binding to a second member of the specific binding pair (which in this case is a ligand (antigen) specifically bound by the scFv) on the surface of a second cell, the transcription factor (in this case, tTa) is released in the first cell and induces transcription of a nucleic acid encoding an apoptosis inducer (in this case, tBID). The tBID is produced in the first cell, and induces apoptosis in the first cell. This example is illustrated schematically in FIG. 8.

Use of Chimeric Notch Receptor Polypeptides in the Targeted Delivery and Secretion of Biologic Agents A chimeric Notch receptor polypeptide of the present disclosure can be used to control expression and secretion of biological molecules, such as cytokines, growth factors, antibodies, and other binding, agonist, trapping, or blocking agents that are genetically encoded.

Binding of a chimeric Notch receptor (or combinations of chimeric Notch receptors that work cooperatively) can be used to sense a particular region, tissue or cell type in the body, which then triggers the localized expression/delivery of the secreted biologic to that site. Control of delivery of the biologic could be via indirect control (control of transcription of the agent), or via control of other processes involved in expression, processing and secretion of the biologic.

Combinatorial Use of Chimeric Notch Receptor Polypeptides—Multiple Receptors in Parallel; a Chimeric Notch Polypeptide and a CAR The present disclosure provides a method of modulating an activity of a cell that expresses: i) a chimeric Notch polypeptide of the present disclosure; and b) a chimeric antigen receptor. The method involves contacting a cell, which expresses both a chimeric Notch receptor polypeptide of the present disclosure and a CAR, with: i) a second member of the specific binding pair (where the second member of the specific binding pair binds to the first member, present in the chimeric Notch receptor polypeptide, of the specific binding pair); and ii) the antigen to which the CAR binds. In these embodiments, modulation of activity of the cell requires both a second member of the specific binding pair, and the antigen to which the CAR specifically binds.

In some cases, the CAR comprises an extracellular domain, a transmembrane region and an intracellular signaling domain; where the extracellular domain comprises a ligand or a receptor linked to an optional support region capable of tethering the extracellular domain to a cell surface, and the intracellular signaling domain comprises the signaling domain from the zeta chain of the human CD3 complex (CD3zeta) and one or more costimulatory signaling domains, such as those from CD28, 4-1BB and OX-40. The extracellular domain contains a recognition element (e.g., an antibody or other target-binding scaffold) that enables the CAR to bind a target. In some cases, a CAR comprises the antigen binding domains of an antibody (e.g., an scFv) linked to T-cell signaling domains. In some cases, when expressed on the surface of a T cell, the CAR can direct T cell activity to those cells expressing a receptor or ligand for which this recognition element is specific. As an example, a CAR that contains an extracellular domain that contains a recognition element specific for a tumor antigen can direct T cell activity to tumor cells that bear the tumor antigen. The intracellular region enables the cell (e.g., a T cell) to receive costimulatory signals. The costimulatory signaling domains can be selected from CD28, 4-1BB, OX-40 or any combination of these. Exemplary CARs comprise a human CD4 transmembrane region, a human IgG4 Fc and a receptor or ligand that is tumor-specific, such as an IL13 or IL3 molecule.

The extracellular domain is made up of a soluble receptor ligand (that is specific for a target tumor antigen or other tumor cell-surface molecule) linked to an optional support region capable of tethering the extracellular domain to a cell surface In some cases, the CAR is a heterodimeric, conditionally active CAR, as described in WO 2014/127261.

The chimeric notch receptor can also be used to similarly modulate the activity of any other natural, chimeric, or orthogonal receptor whose activity is not constitutively present in the cell, or whose activity is not normally present in the cell, thereby altering the signals the cell responds to.

Figure 9B:
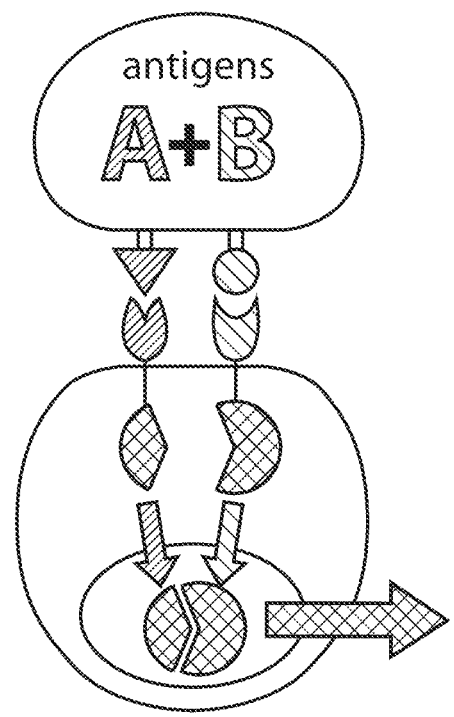

Combinatorial Use of Chimeric Notch Receptor Polypeptides—Multiple Receptors in Parallel; Two Different Chimeric Notch Polypeptides The present disclosure provides a method of modulating an activity of a cell that expresses: i) a first chimeric Notch polypeptide of the present disclosure; and b) a second chimeric Notch polypeptide of the present disclosure. For example, in some cases, the cell expresses: i) a first chimeric Notch receptor polypeptide comprising a first member of a first specific binding pair; and ii) at least a second chimeric Notch receptor polypeptide comprising a first member of a second specific binding pair, where the first and the second specific binding pairs are different from one another such that binding of a second member of the first specific binding pair to the first member of the first specific binding pair does not result in release of the intracellular domain of the second chimeric Notch receptor polypeptide, and such that binding of a second member of the second specific binding pair to the first member of the second specific binding pair does not result in release of the intracellular domain of the first second chimeric Notch receptor polypeptide. In these embodiments, the intracellular domain of the first chimeric Notch receptor polypeptide provides a first effector function; and the intracellular domain of the second chimeric Notch receptor polypeptide provides a second effector function that is different from the first effector function. A schematic illustration of these embodiments is presented in FIG. 9A.

The present disclosure provides a method of modulating an activity of a cell that expresses: i) a first chimeric Notch polypeptide of the present disclosure; and b) a second chimeric Notch polypeptide of the present disclosure. For example, in some cases, the cell expresses: i) a first chimeric Notch receptor polypeptide comprising a first member of a first specific binding pair; and ii) at least a second chimeric Notch receptor polypeptide comprising a first member of a second specific binding pair, where the first and the second specific binding pairs are different from one another such that binding of a second member of the first specific binding pair to the first member of the first specific binding pair does not result in release of the intracellular domain of the second chimeric Notch receptor polypeptide, and such that binding of a second member of the second specific binding pair to the first member of the second specific binding pair does not result in release of the intracellular domain of the first second chimeric Notch receptor polypeptide. In these embodiments, the released intracellular domain of the first chimeric Notch receptor polypeptide binds to (or otherwise operably interacts with) the released intracellular domain of the second chimeric Notch receptor polypeptide to provide an effector function. The released intracellular domain of the first chimeric Notch receptor polypeptide by itself does not provide the effector function; and the released intracellular domain of the second chimeric Notch receptor polypeptide by itself does not provide the effector function. However, the two released intracellular domains together provide an effector function. A schematic illustration of these embodiments is presented in FIG. 9A.

A similar embodiment could utilize indirect regulation by the two different chimeric Notch receptors, whereby each of the two different chimeric Notch receptors would induce the expression of effectors that, only when expressed together, would induce the effector function.

A chimeric Notch receptor of the present disclosure can also be used to similarly modulate the activity of any other natural, chimeric, or orthogonal receptor whose activity is not constitutively present in the cell or not normally present in the cell.

Figure 10:
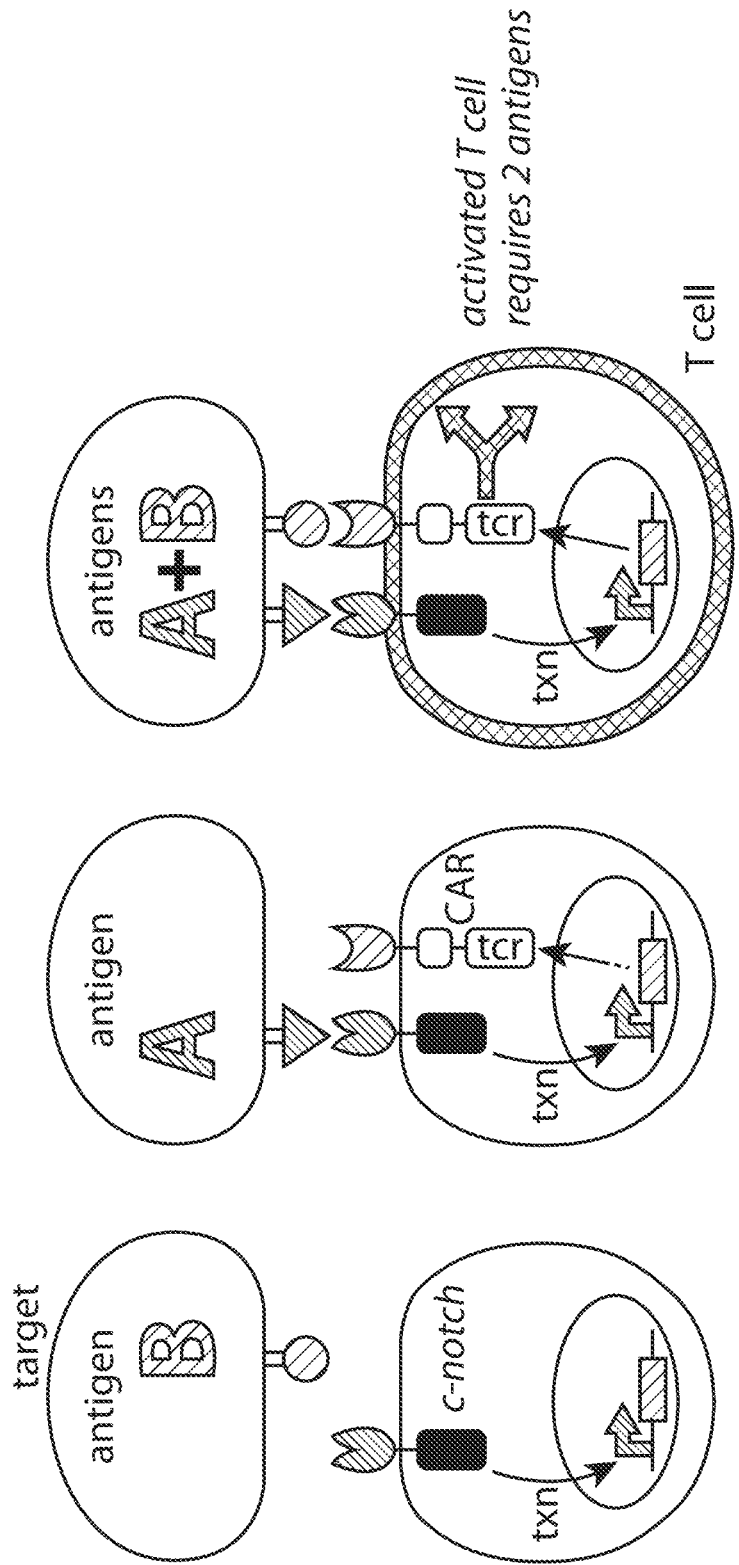
FIG. 10 provides a schematic depiction of use of multiple chimeric Notch receptor polypeptides in series.

Combinatorial Use of Chimeric Notch Receptor Polypeptides—Multiple Receptors in Series; a Chimeric Notch Polypeptide and a CAR The present disclosure provides a method of modulating an activity of a cell that is genetically modified with: a) a nucleic acid comprising a nucleotide sequence encoding a chimeric Notch polypeptide of the present disclosure; and b) a nucleic acid comprising a nucleotide sequence encoding a chimeric antigen receptor, where the nucleotide sequence encoding the chimeric antigen receptor is under control of an inducible promoter. The method involves: i) contacting the cell, which expresses the chimeric Notch receptor polypeptide of the present disclosure (but which does not express the CAR), with a second member of the specific binding pair (where the second member of the specific binding pair binds to the first member, present in the chimeric Notch receptor polypeptide, of the specific binding pair), where contacting the cell with the second member of the specific binding pair induces release of the intracellular domain of the chimeric Notch receptor polypeptide, where the intracellular domain is a transcription factor that activates transcription of the nucleic acid comprising a nucleotide sequence encoding a chimeric antigen receptor, resulting in expression of the CAR; and ii) after the contacting step of (i), contacting the cell with the antigen to which the CAR binds. The second contacting step results in modulation of activity by the CAR. In these embodiments, modulation of activity of the cell requires both a second member of the specific binding pair, and the antigen to which the CAR specifically binds. An example of these embodiments is illustrated schematically in FIG. 10.

A chimeric Notch receptor of the present disclosure can also be used to similarly modulate the activity of any other natural, chimeric, or orthogonal receptor whose activity is not constitutively present in the cell or not normally present in the cell.

In some cases, the cell is genetically modified to produce two or more chimeric Notch receptor polypeptides of the present disclosure. Thus, in some cases, the present disclosure provides a method of modulating an activity of a cell that is genetically modified with: a) a nucleic acid comprising a nucleotide sequence encoding two or more (e.g., 2, 3, 4, or more) chimeric Notch polypeptide of the present disclosure; and b) a nucleic acid comprising a nucleotide sequence encoding a chimeric antigen receptor, where the nucleotide sequence encoding the chimeric antigen receptor is under control of an inducible promoter. The method involves: i) contacting the cell, which expresses the two or more chimeric Notch receptor polypeptides of the present disclosure (but which does not express the CAR), with a second member of the specific binding pair (where the second member of the specific binding pair binds to the first member, present in the chimeric Notch receptor polypeptide, of the specific binding pair), where contacting the cell with the second member of the specific binding pair induces release of the intracellular domain of at least one of the two or more chimeric Notch receptor polypeptide, where the intracellular domain is a transcription factor that activates transcription of the nucleic acid comprising a nucleotide sequence encoding a chimeric antigen receptor, resulting in expression of the CAR; and ii) after the contacting step of (i), contacting the cell with the antigen to which the CAR binds. The second contacting step results in modulation of activity by the CAR. In these embodiments, modulation of activity of the cell requires both a second member of the specific binding pair, and the antigen to which the CAR specifically binds.

A chimeric Notch receptor of the present disclosure can also be used to similarly modulate the activity of any other natural, chimeric, or orthogonal receptor whose activity is not constitutively present in the cell or not normally present in the cell. Multiple chimeric Notch receptor polypeptides that function together can similarly be used to modulate the activity of any other natural, chimeric, or orthogonal receptor whose activity is not constitutively present in the cell or not normally present in the cell.

Combinatorial Use of Chimeric Notch Receptor Polypeptides—Multiple Receptors in Series; Two Different Chimeric Notch Polypeptides The present disclosure provides a method of modulating an activity of a cell that is genetically modified with: i) a nucleic acid comprising a nucleotide sequence encoding a first chimeric Notch polypeptide of the present disclosure; and b) a nucleic acid comprising a nucleotide sequence encoding a second chimeric Notch polypeptide of the present disclosure. For example, in some cases, the cell is genetically modified with: i) a nucleic acid comprising a nucleotide sequence encoding a first chimeric Notch receptor polypeptide comprising a first member of a first specific binding pair; and ii) a nucleic acid comprising a nucleotide sequence encoding at least a second chimeric Notch receptor polypeptide comprising a first member of a second specific binding pair, where the first and the second specific binding pairs are different from one another such that binding of a second member of the first specific binding pair to the first member of the first specific binding pair does not result in release of the intracellular domain of the second chimeric Notch receptor polypeptide, and such that binding of a second member of the second specific binding pair to the first member of the second specific binding pair does not result in release of the intracellular domain of the first second chimeric Notch receptor polypeptide. In these embodiments, the intracellular domain of the first chimeric Notch receptor polypeptide provides a first effector function, where the effector function provides for induction of transcription of the second chimeric Notch polypeptide; and the intracellular domain of the second chimeric Notch receptor polypeptide provides a second effector function that is different from the first effector function.

Figure 11:
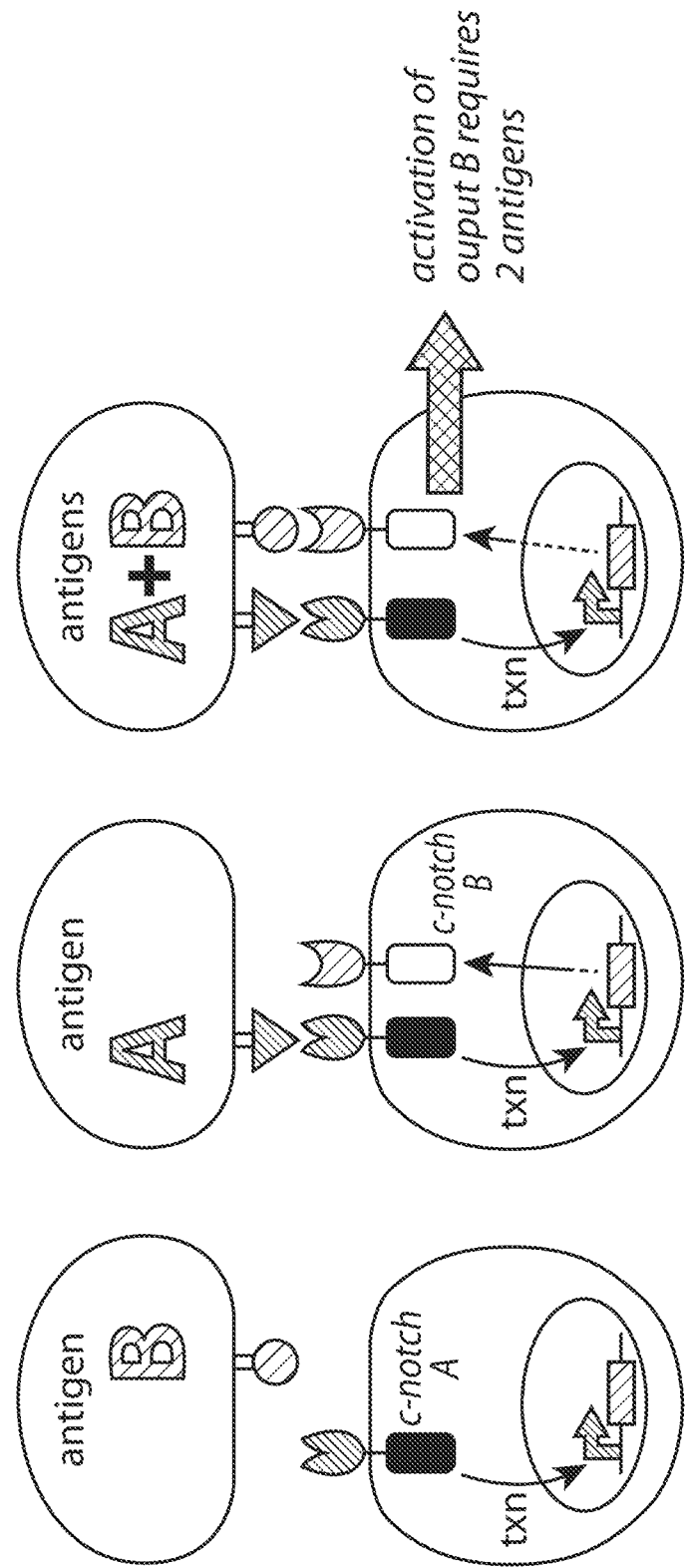
FIG. 11 provides a schematic depiction of use of a chimeric Notch receptor polypeptide and a chimeric antigen receptor (CAR) in series.

The method involves: i) contacting the cell, which expresses the first chimeric Notch receptor polypeptide (but which does not express the second chimeric Notch receptor polypeptide), with a second member of the first specific binding pair (where the second member of the first specific binding pair binds to the first member, present in the first chimeric Notch receptor polypeptide, of the first specific binding pair), where contacting the cell with the second member of the first specific binding pair induces release of the intracellular domain of the first chimeric Notch receptor polypeptide, where the intracellular domain of the first chimeric Notch receptor polypeptide is a transcription factor that activates transcription of the nucleic acid comprising a nucleotide sequence encoding the second chimeric Notch receptor polypeptide, resulting in expression of the second chimeric Notch receptor polypeptide; and ii) after the contacting step of (i), contacting the cell with the second member of the second specific binding pair (where the second member of the second specific binding pair binds to the first member, present in the second chimeric Notch receptor polypeptide, of the second specific binding pair). The second contacting step results in release of the intracellular domain of the second chimeric Notch receptor polypeptide, where the intracellular domain of the second chimeric Notch receptor polypeptide provides an effector function that modulates activity of the cell. In these embodiments, modulation of activity of the cell requires contacting the cell first with a second member of the first specific binding pair, and then with the second member of the second specific binding pair. An example of these embodiments is illustrated schematically in FIG. 11.

Two or more chimeric Notch receptors of the present disclosure can also be used in series in this manner to similarly modulate the activity of any other natural, chimeric, or orthogonal receptor whose activity is not constitutively present in the cell or not normally present in the cell.

Methods Involving Multiple Receptor Circuits with Two or More Cells

The present disclosure provides a method for modulating the activity of a first cell, the method comprising contacting the first cell with a second cell, where the second cell expresses a chimeric Notch receptor polypeptide comprising an extracellular domain comprising a first member of a specific binding pair; and where the second cell expresses on its surface a molecule comprising the second member of the specific binding pair. In some cases, contacting of the first cell with the second cell modulates an activity in the first cell. In some cases, contacting of the first cell with the second cell modulates an activity in the second cell.

Figure 12:
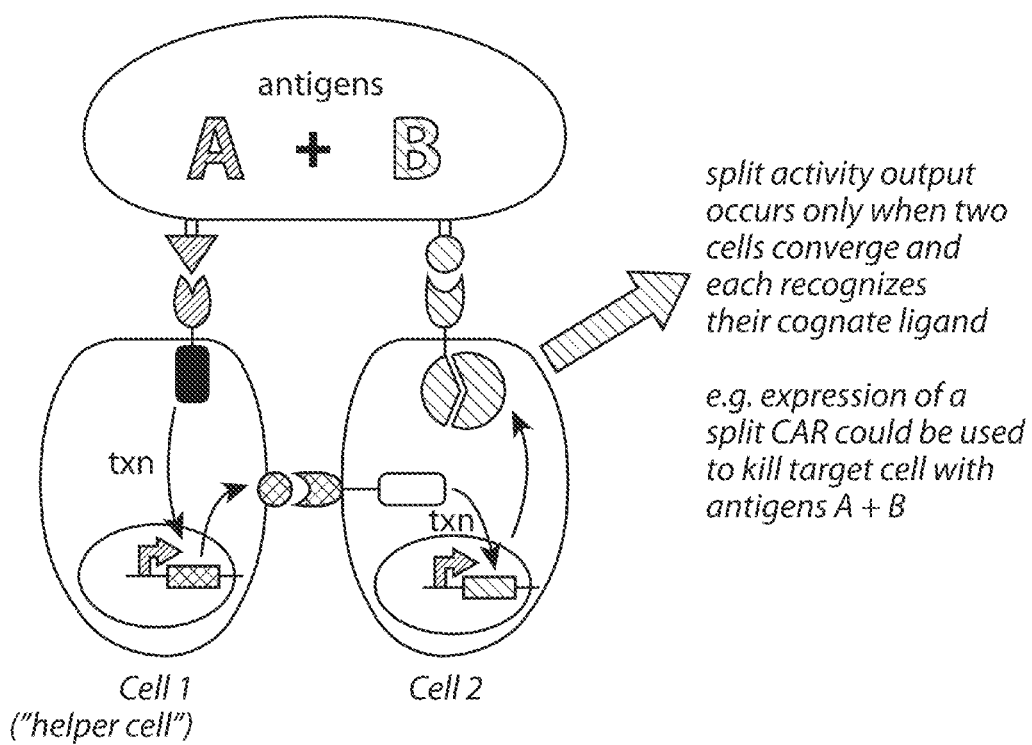
FIG. 12 provides a schematic depiction of use of a chimeric Notch receptor polypeptide in two or more cells, showing multi-cell cooperativity.

The present disclosure provides a method of modulating the activity of a first cell, the method involving contacting the first cell with a second cell, where the second cell expresses a first chimeric Notch receptor polypeptide comprising an extracellular domain comprising a first member of a first specific binding pair; and the first cell expresses a second chimeric Notch receptor polypeptide comprising an extracellular domain comprising a first member of a second specific binding pair, and where the first cell comprises a nucleic acid comprising a nucleotide sequence encoding a CAR. The second cell is contacted with a second member of the first specific binding pair, resulting in release of the intracellular domain of the first chimeric Notch receptor polypeptide, where the intracellular domain of the first chimeric Notch receptor polypeptide is a transcription factor that induces transcription of a nucleic acid encoding the second member of the second specific binding pair. The second member of the second specific binding pair is expressed on the surface of the second cell. When the second member of the second specific binding pair, expressed on the surface of the second cell, comes into contact with the first cell, the second member of the second specific binding pair binds to the first member present in the second chimeric Notch receptor polypeptide present on the cell surface of the first cell, resulting in release of the intracellular domain of the second chimeric Notch receptor polypeptide. The intracellular domain of the second chimeric Notch receptor polypeptide can be, e.g., a transcription factor that induces transcription of all or a part of a CAR, such that the CAR is expressed on the surface of the first cell. In some cases, the first chimeric Notch receptor polypeptide present on the surface of the second cell, and the CAR present on the surface of the first cell, recognize two separate antigens present on the surface of a third cell. In some cases, the third cell is a target cell. In some cases, the second cell is a "helper cell" that, when contacted with the first antigen, results in expression of the CAR on the surface of the first cell, where the CAR recognizes the second antigen on the target cell. These embodiments are illustrated schematically in FIG. 12.

Methods of Modulating Cell Activity in a Multicellular Environment

Figure 13:
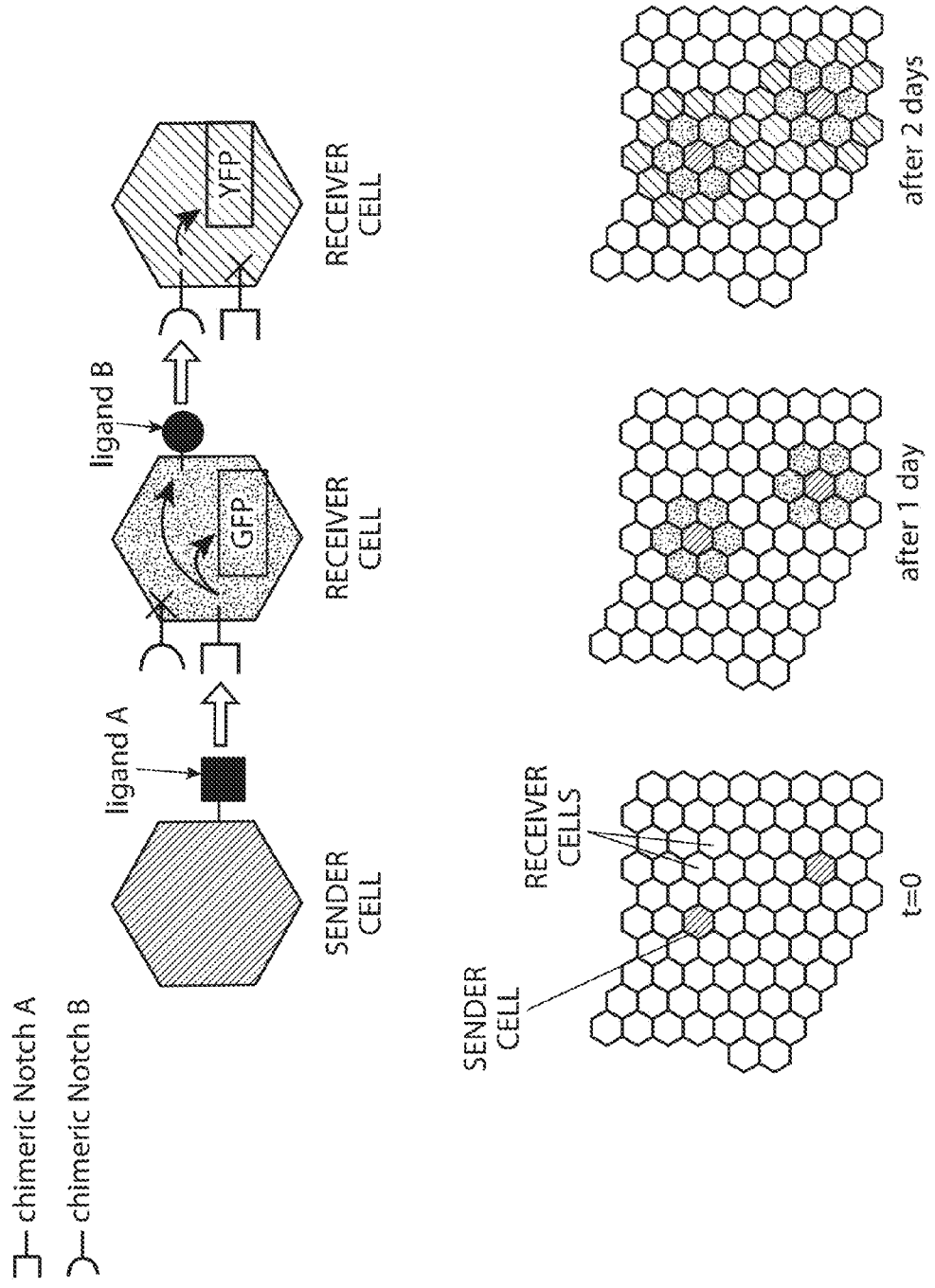
FIG. 13 provides a schematic depiction of use of a chimeric Notch receptor polypeptide in a multicellular environment.

A method of the present disclosure for modulating activity of a cell can be carried out in a multicellular environment. For example, a first chimeric Notch receptor polypeptide, present in a first cell ("first receiver cell"), can comprise an intracellular domain that, when released after binding to a first ligand on a neighboring cell (e.g., a "sender" cell), provides for transcription of a second ligand to which a second chimeric Notch receptor polypeptide on a second cell binds, where the second ligand is expressed on the surface of the first cell. The second cell ("second receiver cell") expresses the second chimeric Notch receptor polypeptide on its surface; upon interaction with the first receiver cell, an intracellular effector function in the second receiver cell is released an provides for modulation of the activity of the second receiver cell. These embodiments are illustrated schematically in FIG. 13. Such a method is useful for, e.g., constructing organized tissues; tracking cell connectivities; and the like.

Methods of Modulating Cell Activity Involving Dual Recognition of a Target Cell

Figure 14:
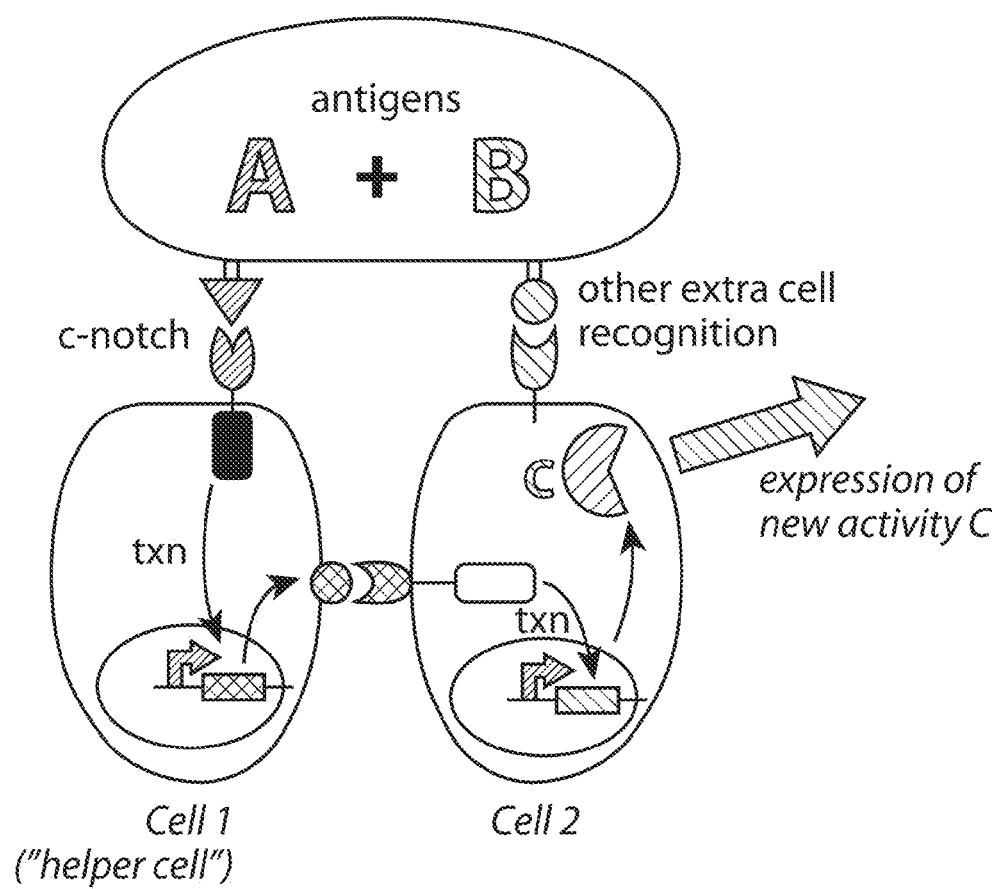
FIG. 14 provides a schematic depiction of use of multiple receptor circuits with two or more cells.
Figure 15:
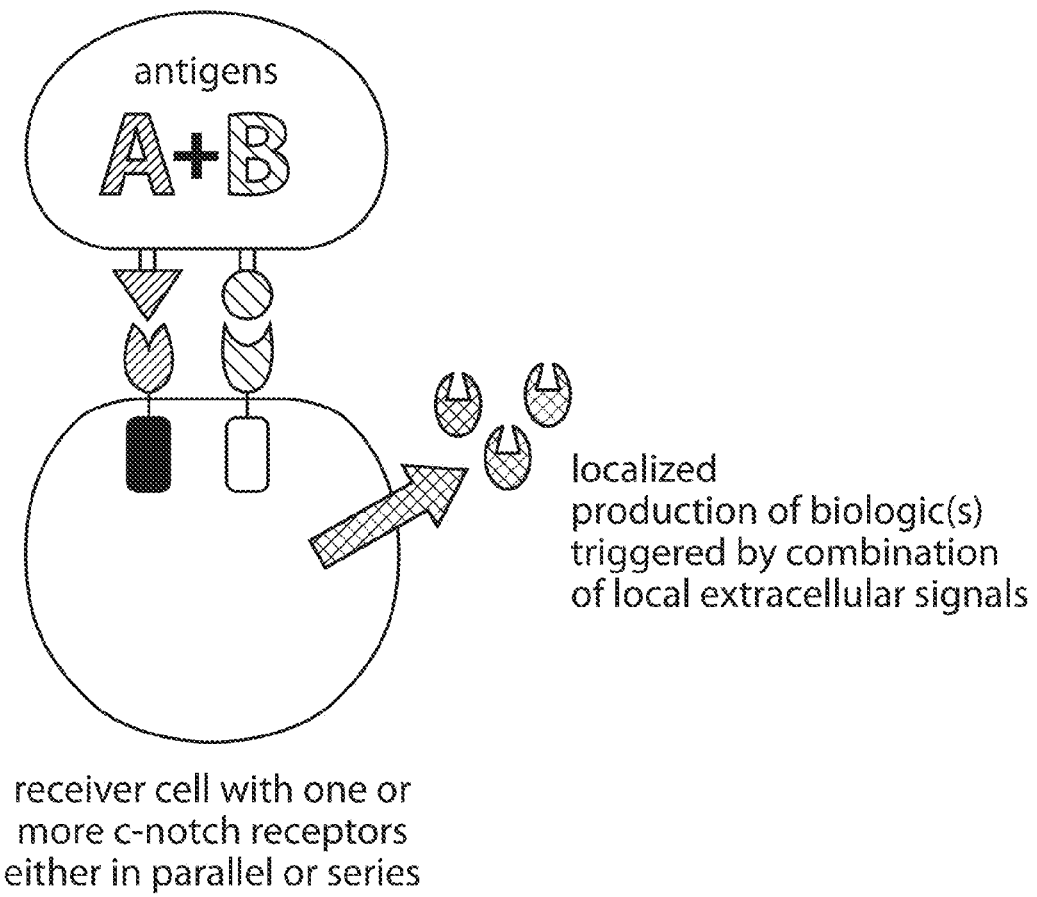
FIG. 15 provides a schematic depiction of localized/targeted production of biologics in response to specific extracellular structures.

In some cases, a method of the present disclosure for modulating activity of a cell involves recognition of two separate target molecules on a target cell. For example, a first cell expressing a chimeric Notch receptor polypeptide of the present disclosure recognizes a first target molecule on a target cell; and a second cell expressing on its cell surface a receptor or other recognition molecule that binds a second target molecule on the target cell. Binding of the first and second cells to the first and second target molecules on the target cell results in expression of a new effector function (e.g., a new gene product, such as a new polypeptide) by the second cell. In some cases, binding of the first cell to the first target molecule on the target cell induces expression in the first cell of a gene product (e.g., a polypeptide); where in some cases, the new gene product produced by the first cell is expressed on the surface of the first cell and binds to a receptor or other recognition molecule on the surface of the second cell, which binding may result modulation of an activity of the second cell (e.g., induction of transcription of a nucleic acid such that the second cell expresses a new effector function (e.g., a new gene product, such as a new polypeptide). In some cases, binding of the first and second cells to the first and second target molecules on the target cell results in killing of the target cell by the second cell, or killing of the target cell by the new effector function expressed by the second cell. In some cases, binding of the first and second cells to the first and second target molecules on the target cell results in modulation of an activity of the target cell; e.g., where modulation of the activity of the target cell is induced by the new effector function produced by the second cell. These embodiments are illustrated schematically in FIG. 14.

Methods

The present disclosure provides a method of modulating an activity of a cell that expresses binding-triggered transcriptional switch (e.g., a chimeric Notch polypeptide of the present disclosure; a MESA polypeptide; a TANGO polypeptide; and the like). Methods of the present disclosure for modulating the activity of a cell can be carried out in vitro, ex vivo, or in vivo. Methods of the present disclosure for modulating the activity of a cell can be carried out in a single cell, or in a multicellular environment (e.g., a naturally-occurring tissue; an artificial tissue; etc.). Methods of the present disclosure for modulating the activity of a cell can be carried out in parallel or in series.

The present disclosure provides a method of locally modulating an activity of a cell. The method generally involves: a) expressing in the cell a binding-triggered transcriptional switch comprising an extracellular domain comprising a first member of a specific binding pair, a binding-transducer and an intracellular domain; and b) contacting the cell with a second member of the specific binding pair. Binding of the first member of the specific binding pair to the second member of the specific binding pair induces the binding-transducer to transduce a binding signal to activate the intracellular domain, thereby producing an activated intracellular domain. The activated intracellular domain modulates an activity of the cell. Activities of the cell that can be modulating using the method include, but are not limited to, i) expression of a gene product of the cell; ii) proliferation of the cell; iii) apoptosis of the cell; iv) non-apoptotic death of the cell; v) differentiation of the cell; vi) dedifferentiation of the cell; vii) migration of the cell; viii) secretion of a molecule from the cell; and ix) cellular adhesion of the cell. In some cases, the contacting step is carried out in vivo. In some cases, the contacting step is carried out ex vivo. In some cases, the contacting step is carried out in vitro.

The present disclosure provides a method of locally modulating an activity of a cell. The method generally involves: a) expressing in the cell a chimeric Notch polypeptide of the present disclosure, where the chimeric Notch polypeptide comprises: i) an extracellular domain comprising a first member of a specific binding pair; ii) a Notch receptor polypeptide, where the Notch receptor polypeptide is as described above, and comprises one or more ligand-inducible proteolytic cleavage sites; and iii) an intracellular domain; and b) contacting the cell with a second member of the specific binding pair. Binding of the first member of the specific binding pair to a second member of the specific binding pair induces cleavage of the Notch receptor polypeptide at the one or more ligand-inducible proteolytic cleavage sites, thereby releasing the intracellular domain. The released intracellular domain modulates an activity of the cell. Activities of the cell that can be modulating using the method include, but are not limited to, i) expression of a gene product of the cell; ii) proliferation of the cell; iii) apoptosis of the cell; iv) non-apoptotic death of the cell; v) differentiation of the cell; vi) dedifferentiation of the cell; vii) migration of the cell; viii) secretion of a molecule from the cell; and ix) cellular adhesion of the cell. In some cases, the contacting step is carried out in vivo. In some cases, the contacting step is carried out ex vivo. In some cases, the contacting step is carried out in vitro.

The present disclosure provides a method of locally modulating an activity of a cell. The method generally involves: a) expressing in the cell a MESA polypeptide comprising an extracellular domain comprising a first member of a specific binding pair, a binding-transducer and an intracellular domain; and b) contacting the cell with a second member of the specific binding pair. Binding of the first member of the specific binding pair to the second member of the specific binding pair induces the binding-transducer to transduce a binding signal to release the intracellular domain, thereby producing a released intracellular domain. The released intracellular domain modulates an activity of the cell. Activities of the cell that can be modulating using the method include, but are not limited to, i) expression of a gene product of the cell; ii) proliferation of the cell; iii) apoptosis of the cell; iv) non-apoptotic death of the cell; v) differentiation of the cell; vi) dedifferentiation of the cell; vii) migration of the cell; viii) secretion of a molecule from the cell; and ix) cellular adhesion of the cell. In some cases, the contacting step is carried out in vivo. In some cases, the contacting step is carried out ex vivo. In some cases, the contacting step is carried out in vitro.

The present disclosure provides a method of locally modulating an activity of a cell. The method generally involves: a) expressing in the cell a TANGO polypeptide comprising an extracellular domain comprising a first member of a specific binding pair, a binding-transducer and an intracellular domain; and b) contacting the cell with a second member of the specific binding pair. Binding of the first member of the specific binding pair to the second member of the specific binding pair induces the binding-transducer to transduce a binding signal to release the intracellular domain, thereby producing a released intracellular domain. The released intracellular domain modulates an activity of the cell. Activities of the cell that can be modulating using the method include, but are not limited to, i) expression of a gene product of the cell; ii) proliferation of the cell; iii) apoptosis of the cell; iv) non-apoptotic death of the cell; v) differentiation of the cell; vi) dedifferentiation of the cell; vii) migration of the cell; viii) secretion of a molecule from the cell; and ix) cellular adhesion of the cell. In some cases, the contacting step is carried out in vivo. In some cases, the contacting step is carried out ex vivo. In some cases, the contacting step is carried out in vitro.

In some cases, the activated (or released) intracellular domain modulates expression of an endogenous gene product of the cell. In some cases, the endogenous gene product of the cell is a chemokine, a chemokine receptor, a cytokine, a cytokine receptor, a differentiation factor, a growth factor, a growth factor receptor, a hormone, a metabolic enzyme, a proliferation inducer, a receptor, a small molecule second messenger synthesis enzyme, a T cell receptor, a transcription activator, a transcription repressor, a transcriptional activator, a transcriptional repressor, a translation regulator, a translational activator, a translational repressor, an activating immunoreceptor, an apoptosis in inhibitor, an apoptosis inducer, an immunoactivator, an immunoinhibitor, or an inhibiting immunoreceptor. In some cases, the endogenous gene product is a secreted gene product. In some cases, the endogenous gene product is a cell surface gene product. In some cases, the endogenous gene product is an intracellular gene product. In some cases, the activated intracellular domain simultaneously modulates expression of two or more endogenous gene products in the cell. An "activated intracellular domain" can be a released intracellular domain (e.g., released by proteolytic cleavage of the binding-triggered transcriptional switch. An "activated intracellular domain" can be a phosphorylated intracellular domain, e.g., where the intracellular domain is inactive in its non-phosphorylated state, and active in its phosphorylated state.

In some cases, the activated (or released) intracellular domain modulates expression of a heterologous gene product in the cell. A heterologous gene product is one that is not normally produced by the cell. For example, the cell can be genetically modified with a nucleic acid comprising a nucleotide sequence encoding the heterologous gene product. In some cases, the heterologous gene product is a chemokine, a chemokine receptor, a chimeric antigen receptor, a cytokine, a cytokine receptor, a differentiation factor, a growth factor, a growth factor receptor, a hormone, a metabolic enzyme, a pathogen derived protein, a proliferation inducer, a receptor, a RNA guided nuclease, a site-specific nuclease, a small molecule second messenger synthesis enzyme, a T cell receptor, a toxin derived protein, a transcription activator, a transcription repressor, a transcriptional activator, a transcriptional repressor, a translation regulator, a translational activator, a translational repressor, an activating immunoreceptor, an antibody, an apoptosis in inhibitor, an apoptosis inducer, an engineered T cell receptor, an immunoactivator, an immunoinhibitor, an inhibiting immunoreceptor, an RNA guided DNA binding protein, a synNotch polypeptide of the present disclosure, a MESA polypeptide, a TANGO polypeptide, a CAR, a TCR, or a second binding-triggered transcriptional switch. In some cases, the heterologous gene product is a secreted gene product. In some cases, the heterologous gene product is a cell surface gene product. In some cases, the heterologous gene product is an intracellular gene product. In some cases, the activated intracellular domain simultaneously modulates expression of two or more heterologous gene products in the cell. An "activated intracellular domain" can be a released intracellular domain (e.g., released by proteolytic cleavage of the binding-triggered transcriptional switch. An "activated intracellular domain" can be a phosphorylated intracellular domain, e.g., where the intracellular domain is inactive in its non-phosphorylated state, and active in its phosphorylated state.

In some cases, the activated (e.g., released) intracellular domain induces expression of a heterologous gene product in the cell, where the heterologous gene product is a synNotch polypeptide of the present disclosure. In some cases, the released intracellular domain is an intracellular domain of a first synNotch polypeptide of the present disclosure, where the released intracellular domain of the first synNotch polypeptide induces expression of a second synNotch polypeptide of the present disclosure.

In some cases, the activated (e.g., released) intracellular domain induces expression of a heterologous gene product in the cell, where the heterologous gene product is a CAR. In some cases, released intracellular domain is an intracellular domain of a synNotch polypeptide of the present disclosure, where the released intracellular domain of the synNotch polypeptide induces expression of a CAR.

In some cases, the activated (e.g., released) intracellular domain induces expression of a heterologous gene product in the cell, where the heterologous gene product is a MESA polypeptide. In some cases, released intracellular domain is an intracellular domain of a synNotch polypeptide of the present disclosure, where the released intracellular domain of the synNotch polypeptide induces expression of a MESA polypeptide.

In some cases, the activated (e.g., released) intracellular domain induces expression of a heterologous gene product in the cell, where the heterologous gene product is a TANGO polypeptide. In some cases, released intracellular domain is an intracellular domain of a synNotch polypeptide of the present disclosure, where the released intracellular domain of the synNotch polypeptide induces expression of a TANGO polypeptide.

In some cases, the activated (e.g., released) intracellular domain induces expression of a heterologous gene product in the cell, where the heterologous gene product is a TCR. In some cases, released intracellular domain is an intracellular domain of a synNotch polypeptide of the present disclosure, where the released intracellular domain of the synNotch polypeptide induces expression of a TCR.

In some cases, the activated (e.g., released) intracellular domain induces expression of a heterologous gene product in the cell, where the heterologous gene product is a MESA polypeptide. In some cases, the released intracellular domain is an intracellular domain of a first MESA polypeptide, where the released intracellular domain of the first MESA polypeptide induces expression of a second MESA polypeptide.

In some cases, the activated (e.g., released) intracellular domain induces expression of a heterologous gene product in the cell, where the heterologous gene product is a CAR. In some cases, released intracellular domain is an intracellular domain of a MESA polypeptide, where the released intracellular domain of the MESA polypeptide induces expression of a CAR.

In some cases, the activated (e.g., released) intracellular domain induces expression of a heterologous gene product in the cell, where the heterologous gene product is a synNotch polypeptide of the present disclosure. In some cases, released intracellular domain is an intracellular domain of a MESA polypeptide, where the released intracellular domain of the MESA polypeptide induces expression of a synNotch polypeptide of the present disclosure.

In some cases, the activated (e.g., released) intracellular domain induces expression of a heterologous gene product in the cell, where the heterologous gene product is a TANGO polypeptide. In some cases, released intracellular domain is an intracellular domain of a MESA polypeptide, where the released intracellular domain of the MESA polypeptide induces expression of a TANGO polypeptide.

In some cases, the activated (e.g., released) intracellular domain induces expression of a heterologous gene product in the cell, where the heterologous gene product is a TCR. In some cases, released intracellular domain is an intracellular domain of a MESA polypeptide, where the released intracellular domain of the MESA polypeptide induces expression of a TCR.

In some cases, the activated (e.g., released) intracellular domain induces expression of a heterologous gene product in the cell, where the heterologous gene product is a TANGO polypeptide. In some cases, the released intracellular domain is an intracellular domain of a first TANGO polypeptide, where the released intracellular domain of the first TANGO polypeptide induces expression of a second TANGO polypeptide.

In some cases, the activated (e.g., released) intracellular domain induces expression of a heterologous gene product in the cell, where the heterologous gene product is a CAR. In some cases, released intracellular domain is an intracellular domain of a TANGO polypeptide, where the released intracellular domain of the TANGO polypeptide induces expression of a CAR.

In some cases, the activated (e.g., released) intracellular domain induces expression of a heterologous gene product in the cell, where the heterologous gene product is a synNotch polypeptide of the present disclosure. In some cases, released intracellular domain is an intracellular domain of a TANGO polypeptide, where the released intracellular domain of the TANGO polypeptide induces expression of a synNotch polypeptide of the present disclosure.

In some cases, the activated (e.g., released) intracellular domain induces expression of a heterologous gene product in the cell, where the heterologous gene product is a MESA polypeptide. In some cases, released intracellular domain is an intracellular domain of a TANGO polypeptide, where the released intracellular domain of the TANGO polypeptide induces expression of a MESA polypeptide.

In some cases, the activated (e.g., released) intracellular domain induces expression of a heterologous gene product in the cell, where the heterologous gene product is a TCR. In some cases, released intracellular domain is an intracellular domain of a TANGO polypeptide, where the released intracellular domain of the TANGO polypeptide induces expression of a TCR.

In any of the above-described embodiments, the second member of the specific binding pair can be on the surface of a second cell, can be immobilized on an insoluble substrate, can be present in an extracellular matrix, can be present in an artificial matrix, or can be soluble.

MESA

A modular extracellular sensor architecture (MESA) polypeptide suitable for use in a method of the present disclosure can be a MESA polypeptide as described in U.S. Patent Publication No. 2014/0234851. A MESA polypeptide comprises: a) a ligand binding domain; b) a transmembrane domain; c) a protease cleavage site; and d) a functional domain. The functional domain can be a transcription regulator (e.g., a transcription activator, a transcription repressor). In some cases, a MESA receptor comprises two polypeptide chains. In some cases, a MESA receptor comprises a single polypeptide chain.

TANGO

A suitable TANGO polypeptide is a heterodimer in which a first comprises a tobacco etch virus (Tev) protease and a second polypeptide comprises a Tev proteolytic cleavage site (PCS) fused to a transcription factor. When the two polypeptides are in proximity to one another, which proximity is mediated by a native protein-protein interaction, Tev cleaves the PCS to release the transcription factor. Barnea et al. (Proc Natl Acad Sci USA. 2008 Jan. 8; 105(1):64-9).

TCR

In some cases, a binding-triggered switch induces expression of a T-cell receptor (TCR) in a cell. TCR that can be induced using a method of the present disclosure include TCR that are specific for any of a variety of epitopes, including, e.g., an epitope on the surface of a cancer cell, an epitope on the surface of a virus-infected cell, an epitope present in an autoantigen, and the like. A TCR generally includes an alpha chain and a beta chain; and recognizes antigen when presented by a major histocompatibility complex. In some cases, the TCR is an engineered TCR.

Any engineered TCR having immune cell activation function can be induced using a method of the present disclosure. Such TCRs include, e.g., antigen-specific TCRs, Monoclonal TCRs (MTCRs), Single chain MTCRs, High Affinity CDR2 Mutant TCRs, CD1-binding MTCRs, High Affinity NY-ESO TCRs, VYG HLA-A24 Telomerase TCRs, including e.g., those described in PCT Pub Nos. WO 2003/020763, WO 2004/033685, WO 2004/044004, WO 2005/114215, WO 2006/000830, WO 2008/038002, WO 2008/039818, WO 2004/074322, WO 2005/113595, WO 2006/125962; Strommes et al. Immunol Rev. 2014; 257(1):145-64; Schmitt et al. Blood. 2013; 122(3):348-56; Chapuls et al. Sci Transl Med. 2013; 5(174):174ra27; Thaxton et al. Hum Vaccin Immunother. 2014; 10(11):3313-21 (PMID: 25483644); Gschweng et al. Immunol Rev. 2014; 257(1): 237-49 (PMID:24329801); Hinrichs et al. Immunol Rev. 2014; 257(1):56-71 (PMID:24329789); Zoete et al. Front Immunol. 2013; 4:268 (PMID:24062738); Marr et al. Clin Exp Immunol. 2012; 167(2):216-25 (PMID:22235997); Zhang et al. Adv Drug Deliv Rev. 2012; 64(8):756-62 (PMID:22178904); Chhabra et al. Scientific World Journal. 2011; 11:121-9 (PMID:21218269); Boulter et al. Clin Exp Immunol. 2005; 142(3):454-60 (PMID:16297157); Sami et al. Protein Eng Des Sel. 2007; 20(8):397-403; Boulter et al. Protein Eng. 2003; 16(9):707-11; Ashfield et al. IDrugs. 2006; 9(8):554-9; Li et al. Nat Biotechnol. 2005; 23(3):349-54; Dunn et al. Protein Sci. 2006; 15(4):710-21; Liddy et al. Mol Biotechnol. 2010; 45(2); Liddy et al. Nat Med. 2012; 18(6):980-7; Oates, et al. Oncoimmunology. 2013; 2(2): e22891; McCormack, et al. Cancer Immunol Immunother. 2013 April; 62(4):773-85; Bossi et al. Cancer Immunol Immunother. 2014; 63(5):437-48 and Oates, et al. Mol Immunol. 2015 October; 67(2 Pt A):67-74; the disclosures of which are incorporated herein by reference in their entirety.

CAR

In some cases, a binding-triggered switch induces expression of a CAR in a cell. The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013); 5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al. Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety.

Spit CAR may be extracellularly split or intracellularly split and may or may not be conditionally heterodimerizable. For example, split CAR systems that are not conditionally heterodimerizable may contain a constitutive heterodimerization domain or other binding pair (e.g., a Fc binding pair or other orthogonal binding pair) that does not depend on the presence of one or more additional molecules for the heterodimerization that results in the formation of an active CAR from assembly of the split portions.

In some instances, an extracellularly split CAR may be split extracellularly at the antigen binding domain into two parts including e.g., where the first part of the split CAR contains an extracellular Fc binding domain that specifically binds to second part of the split CAR that contains the antigen recognition domain as generally depicted in FIG. 81A.

In some instances, an extracellularly split CAR may be split extracellularly at the antigen binding domain into two parts including e.g., where the first part of the split CAR contains an first part of an orthogonal protein binding pair that specifically binds to the second part of the orthogonal protein binding pair that is contained in the second part of the split CAR that contains the antigen recognition domain as generally depicted in FIG. 81B.

In some instances, an intracellularly split CAR may be split intracellularly proximal to the transmembrane domain into two parts including e.g., where the first part of the split CAR includes the antigen recognition domain, a transmembrane domain and an intracellular first portion of a constitutive heterodimerization domain and the second part of the split CAR includes a transmembrane domain, the second portion of the constitutive heterodimerization domain proximal to the transmembrane domain, one or more co-stimulatory domains and one or more signaling domains (e.g., ITAM domains) e.g., as generally depicted in FIG. 81C.

In some instances, an intracellularly split CAR may be split into two parts intracellularly proximal to an intracellular domain or between two intracellular domains including e.g., where the first part of the split CAR includes the antigen recognition domain, a transmembrane domain, one or more co-stimulatory domains and an intracellular first portion of a constitutive heterodimerization domain and the second part of the split CAR includes a transmembrane domain, one or more co-stimulatory domains, one or more signaling domains (e.g., ITAM domains) and the second portion of the constitutive heterodimerization domain between the one or more co-stimulatory domains and the one or more signaling domains, e.g., as generally depicted in FIG. 81D.

In some instances, an intracellularly split CAR may be split into two parts intracellularly between intracellular domains including e.g., where the first part of the split CAR includes the antigen recognition domain, a transmembrane domain, one or more co-stimulatory domains and an intracellular first portion of a constitutive heterodimerization domain proximal to the intracellular terminus of the first part of the split CAR and the second part of the split CAR includes a transmembrane domain, one or more signaling domains (e.g., ITAM domains) and the second portion of the constitutive heterodimerization domain between the transmembrane domain and the one or more signaling domains, e.g., as generally depicted in FIG. 81E.

An ordinary skilled artisan will be readily aware that arrangements of the domains within first and second parts of a split CAR are not limited to those arrangements specifically described herein. The specific locations at which a single CAR may be split to generate a split CAR may vary provided that the two or more polypeptides that result from such a split or a plurality of splits are functionally capable of forming a functional CAR upon their concurrent presence within a single cell. Such functional activity may be readily determined including e.g., through the use of one or more of the assays described herein.

First Member of Specific Binding Pair

The first member of the specific binding pair can be the first member of any of a variety of specific binding pairs. Suitable specific binding pairs are described in detail above.

In some cases, the first member of the specific binding pair comprises an antibody-based recognition scaffold. In some cases, the first member of the specific binding pair comprises an antibody. In some cases, where the first member of the specific binding pair is an antibody, the antibody specifically binds a tumor-specific antigen, a disease-associated antigen, or an extracellular matrix component. In some cases, where the first member of the specific binding pair is an antibody, the antibody specifically binds a cell surface antigen, a soluble antigen, or an antigen immobilized on an insoluble substrate. In some cases, where the first member of the specific binding pair is an antibody, the antibody is a single-chain Fv. In some cases, the first member of the specific binding pair is a nanobody, a single-domain antibody, a diabody, a triabody, or a minibody. In some cases, the first member of the specific binding pair is a non-antibody-based recognition scaffold. In some cases, where the first member of the specific binding pair is a non-antibody-based recognition scaffold, the non-antibody-based recognition scaffold is an avimer, a DARPin, an adnectin, an avimer, an affibody, an anticalin, or an affilin. In some cases, the first member of the specific binding pair is an antigen. In some cases, where the first member of the specific binding pair is an antigen, the antigen is an endogenous antigen. In some cases, where the first member of the specific binding pair is an antigen, the antigen is an exogenous antigen. In some cases, the first member of the specific binding pair is a ligand for a receptor. In some cases, the first member of the specific binding pair is a receptor. In some cases, the first member of the specific binding pair is a cellular adhesion molecule (e.g., all or a portion of an extracellular region of a cellular adhesion molecule). In some cases, the first member of the specific binding pair comprises a first dimerization domain and wherein the second member of the specific binding pair comprises a second dimerization domain; for example, in some cases, binding of the first dimerization domain to the second dimerization domain is induced by a small molecule dimerization agent, and in other cases, binding of the first dimerization domain to the second dimerization domain is induced by light.

Second Member of Specific Binding Pair

Specific binding pairs include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

The second member of the specific binding pair can be present on the surface of a cell. The second member of the specific binding pair can be immobilized on an insoluble support. The second member of the specific binding pair can be soluble. The second member of the specific binding pair can be present in an extracellular environment (e.g., extracellular matrix). The second member of the specific binding pair can be present in an artificial matrix. The second member of the specific binding pair can be present in an acellular environment.

Intracellular Domain

In some cases, the intracellular domain is a transcription regulator, e.g., a transcription factor such as a transcriptional activator or a transcriptional repressor. In some cases, the transcription factor directly regulates differentiation of the cell. In some cases, the transcription factor indirectly modulates differentiation of the cell by modulating the expression of a second transcription factor.

Examples of transcriptional regulators include, e.g., ABT1, ACYP2, AEBP1, AEBP2, AES, AFF1, AFF3, AHR, ANK1, ANK2, ANKFY1, ANKIB1, ANKRD1, ANKRD10, ANKRD2, ANKRD32, ANKRD46, ANKRD49, ANKRD56, ANKRD57, ANKS4B, AR, ARHGAP17, ARID1A, ARID1B, ARID3A, ARID4A, ARID5B, ARNT, ARNT2, ARNTL, ARNTL2, ARX, ASB10, ASB11, ASB12, ASB15, ASB2, ASB5, ASB8, ASB9, ASH1L, ASH2L, ASXL1, ASZ1, ATF1, ATF3, ATF4, ATF4, ATF5, ATF6, ATF7, ATF7IP, ATM, ATOH1, ATXN3, 1300003B13RIK, B3GAT3, B930041F14RIK, BACH1, BACH2, BARX1, BARX2, BATF, BATF2, BATF3, BAZ2A, BBX, BC003267, BCL11A, BCL11B, BCL3, BCL6, BCL6B, BCLAF1, BCOR, BHLHA15, BHLHE40, BHLHE41, BLZF1, BMYC, BNC1, BNC2, BPNT1, BRCA1, BRWD1, BTBD11, BTF3, 6030408C04RIK, CAMK4, CARHSP1, CARM1, CBX4, CBX7, CCNC, CCNH, CCNT1, CCNT2, CDC5L, CDK2, CDK4, CDK9, CDKN2C, CDX1, CDX1, CDX2, CEBPA, CEBPB, CEBPD, CEBPG, CEBPG, CEBPZ, CHD4, CHD7, CHGB, CIC, CIITA, CITED1, CITED2, CITED4, CLOCK, CLPB, CML3, CNOT7, COPS2, CREB1, CREB3, CREB3L1, CREB3L1, CREB3L2, CREB3L3, CREB5, CREBBP, CREBL2, CREM, CSDA, CSDA, CSDC2, CSDE1, CTBP2, CTCF, CTCFL, CTNNB1, CTNNBL1, CXXC1, D11BWG0517E, 2300002D11RIK, DACH1, DAXX, DBP, DDIT3, DDX20, DDX54, DDX58, DEAF1, DEK, DIDO1, DLX2, DMRT1, DMRT2, DMRTB1, DNMT1, DNMT3A, DR1, DRG1, DUSP26, DYSFIP1, E2F1, E2F2, E2F3, E2F5, E2F6, EBF1, EBF2, EBF3, EBF3, EED, EGR1, EGR2, EGR3, EHF, EHMT2, EID2, ELAVL2, ELF1, ELF1, ELF2, ELF3, ELF4, ELF5, ELK3, ELK4, ELL2, EMX2, EMX2, EN2, ENPP2, EOMES, EP300, EPAS1, ERF, ERG, ESR1, ESRRA, ESRRB, ESRRG, ETS1, ETS2, ETV1, ETV3, ETV4, ETV5, ETV6, EVI1, EWSR1, EZH1, EZH2, FAH, FBXL10, FBXL11, FBXW7, FEM1A, FEM1B, FEM1C, FHL2, FLI1, FMNL2, FOS, FOSB, FOSL1, FOSL2, FOXA1, FOXA2, FOXA3, FOXC1, FOXD1, FOXD2, FOXD3, FOXF1, FOXF1A, FOXF2, FOXG1, FOXI1, FOXJ2, FOXJ3, FOXK1, FOXK2, FOXL1, FOXL2, FOXM1, FOXN1, FOXN2, FOXN3, FOXO1, FOXO3, FOXP1, FOXP2, FOXP3, FOXP4, FOXQ1, FUS, FUSIP1, 2810021G02RIK, GABPA, GABPB1, GARNL1, GAS7, GATA1, GATA2, GATA3, GATA4, GATA5, GATA5, GATA6, GBX2, GCDH, GCM1, GFI1, GFI1B, GLI2, GLI3, GLIS1, GLIS2, GLIS3, GLS2, GMEB1, GMEB2, GRHL1, GRHL2, GRHL3, GRLF1, GTF2A1, GTF2B, GTF2E2, GTF2F1, GTF2F2, GTF2H2, GTF2H4, GTF2I, GTF2IRD1, GTF2IRD1, GZF1, HAND2, HBP1, HCLS1, HDAC10, HDAC11, HDAC2, HDAC5, HDAC9, HELZ, HES1, HES4, HES5, HES6, HEXIM1, HEY2, HEYL, HHEX, HHEX, HIC1, HIC2, HIF1A, HIF1AN, HIPK2, HIVEP1, HIVEP2, HIVEP2, HIVEP3, HLF, HLTF, HLX, HMBOX1, HMG20A, HMGA2, HMGB2, HMGB3, HNF1B, HNF4A, HNF4G, HOMEZ, HOXA10, HOXA11, HOXA13, HOXA2, HOXA3, HOXA4, HOXA5, HOXA6, HOXA7, HOXA9, HOXB1, HOXB2, HOXB3, HOXB4, HOXB6, HOXB7, HOXB8, HOXB9, HOXC10, HOXC10, HOXC11, HOXC5, HOXC6, HOXC8, HOXC9, HOXD8, HOXD9, HR, HSBP1, HSF2BP, HTATIP2, HTATSF1, HUWE1, 5830417I10RIK, ID1, ID2, ID3, ID3, IFNAR2, IKBKB, IKBKG, IKZF1, IKZF2, IKZF3, IKZF4, IL31RA, ILF3, ING1, ING2, ING3, ING4, INSM1, INTS12, IQWD1, IRF1, IRF1, IRF2, IRF3, IRF4, IRF5, IRF6, IRF7, IRF8, IRF8, IRX1, IRX2, IRX3, IRX4, IRX5, ISL1, ISL2, ISX, ISX, IVNS1ABP, 2810021J22RIK, JARID1A, JARID1B, JARID1C, JARID1D, JDP2, JUN, JUNB, JUND, KLF1, KLF10, KLF11, KLF12, KLF13, KLF15, KLF16, KLF2, KLF3, KLF3, KLF4, KLF5, KLF6, KLF7, KLF8, KLF9, KRR1, 6330416L07RIK, L3MBTL2, LASS2, LASS4, LASS6, LBA1, LBH, LBX1, LCOR, LDB1, LDB2, LEF1, LHX1, LHX2, LHX5, LIMD1, LIN28, LMO1, LMO4, LMX1A, LSM11, LSM4, LYL1, 9030612M13RIK, 1810007M14RIK, 3632451O06RIK, MAF, MAFA, MAFB, MAFF, MAFG, MAFK, MAGED1, MAP3K12, MAPK1, MAPK3, MAPK8, MAPK8IP1, MAX, MAZ, MBD2, MCM2, MCM4, MCM5, MCM6, MCM7, MECOM, MECP2, MED12, MED8, MEF2A, MEF2B, MEF2C, MEF2D, MEIS1, MEIS1, MEIS2, MEOX2, MESP2, MID1, MITF, MKI67IP, MKL1, MLL1, MLL3, MLLT10, MLLT3, MLX, MLXIP, MLXIPL, MNT, MNX1, MPL, MSC, MSRB2, MSX2, MTA3, MTF1, MTF2, MTPN, MXD1, MXD4, MXI1, MYB, MYBBP1A, MYBL2, MYC, MYCBP, MYCL1, MYCN, MYEF2, MYF6, MYNN, MYOCD, MYOD1, MYOG, MYST3, MYST4, MYT1L, MZF1, NAB1, NAB2, NANOG, NARG1, NCOA1, NCOA2, NCOA3, NCOR1, NCOR2, NDN, NEUROD1, NEUROD4, NEUROD6, NEUROG1, NEUROG2, NFAT5, NFATC1, NFATC2, NFATC2IP, NFATC3, NFATC3, NFATC4, NFE2, NFE2L1, NFE2L2, NFIA, NFIA, NFIB, NFIC, NFIL3, NFIX, NFKB1, NFKB2, NFKBIB, NFKBIE, NFKBIZ, NFX1, NFXL1, NFYA, NFYB, NHLH1, NKX2-2, NKX2-3, NKX2-5, NKX2-6, NKX6-2, NMI, NOTCH1, NOTCH2, NOTCH3, NOTCH4, NPAS1, NPAS2, NPAS3, NR0B1, NR0B2, NR1D1, NR1D2, NR1H3, NR1H4, NR1I2, NR1I3, NR2C1, NR2C2, NR2E3, NR2F1, NR2F2, NR2F6, NR3C1, NR3C2, NR4A1, NR4A2, NR4A2, NR4A3, NR5A1, NR5A2, NRARP, NRIP1, NRIP2, NSBP1, NSD1, NUDT12, NULL, NUPR1, 1700065O13RIK, OLIG1, OLIG2, OLIG2, ONECUT1, ONECUT2, ONECUT3, ORC2L, OSGIN1, OSR1, OSR2, OSTF1, OVOL1, OVOL2, PAPOLA, PAPOLG, PAPPA2, PATZ1, PAWR, PAX2, PAX5, PAX6, PAX7, PAX8, PAX9, PBX1, PBX2, PBX3, PBX4, PCBD1, PCGF6, PDCD11, PDLIM4, PDX1, PEG3, PER1, PFDN1, PGR, PHF1, PHF10, PHF12, PHF13, PHF14, PHF20, PHF21A, PHF5A, PHF7, PHOX2A, PHOX2B, PIAS2, PIR, PITX1, PITX2, PKNOX1, PKNOX2, PLA2G6, PLAGL1, PLAGL2, PLRG1, PML, POGK, POLR2B, POLR2E, POLR2H, POLR3E, POLR3H, POLRMT, POU1F1, POU2AF1, POU2F1, POU2F2, POU3F2, POU3F3, POU3F3, POU5F1, POU6F1, PPARA, PPARD, PPARG, PPARGC1A, PPARGC1B, PPP1R12C, PPP1R13B, PPP1R16B, PPP1R1B, PPP2R1A, PPP3CB, PQBP1, PRDM1, PRDM14, PRDM15, PRDM16, PRDM2, PRDM4, PRDM5, PRDM6, PRDM8, PREB, PRKAR1A, PRKCBP1, PROX1, PRRX1, PRRX2, PSMC5, PSMD10, PSMD9, PTF1A, PTGES2, PURB, PWP1, RAB11A, RAB11B, RAB15, RAB18, RAB1B, RAB25, RAB8A, RAB8B, RAI14, RARA, RARB, RARG, RASSF7, RB1, RBBP7, RBL1, RBM14, RBM39, RBM9, RBPJ, RBPJL, RCOR2, REL, RELA, RELB, RERE, REST, REXO4, RFC1, RFX1, RFX2, RFX3, RFX5, RFX7, RFX8, RHOX5, RHOX6, RHOX9, RIPK4, RNF12, RNF14, RNF141, RNF38, RNF4, RORA, RORA, RORB, RORC, RPS6KA4, RREB1, RSRC1, RUNX1, RUNX1T1, RUNX2, RUNX2, RUNX3, RUVBL1, RUVBL2, RXRA, RXRG, RYBP, SAFB2, SALL1, SALL1, SALL2, SALL4, SAP30, SAP30BP, SATB1, SATB2, SATB2, SCAND1, SCAP, SCRT2, SEC14L2, SERTAD1, SF1, SFPI1, SFRS5, SH3D19, SH3PXD2B, SHANK3, SHOX2, SHPRH, SIN3A, SIN3B, SIRT2, SIRT3, SIRT5, SIX1, SIX1, SIX2, SIX3, SIX4, SIX5, SKI, SMAD1, SMAD2, SMAD3, SMAD7, SMARCA1, SMARCA2, SMARCA5, SMARCB1, SMYD1, SNAI1, SNAI2, SNAPC2, SNAPC4, SNIP1, SOLH, SOX1, SOX10, SOX11, SOX12, SOX13, SOX15, SOX17, SOX18, SOX2, SOX21, SOX4, SOX5, SOX6, SOX7, SOX8, SOX9, SP1, SP110, SP140L, SP2, SP3, SP4, SP6, SP8, SPDEF, SPEN, SPI1, SPIB, SQSTM1, SREBF1, SREBF2, SREBF2, SRF, SSBP2, SSBP3, SSBP4, SSRP1, ST18, STAG1, STAT1, STAT1, STAT2, STAT3, STAT4, STAT5A, STAT5B, STAT5B, STAT6, SUB1, SUZ12, TADA2L, TAF13, TAF5, TAF5L, TAF7, TAF9, TAL1, TAL1, TARDBP, TBPL1, TBR1, TBX1, TBX10, TBX15, TBX18, TBX2, TBX2, TBX20, TBX21, TBX3, TBX4, TBX5, TBX6, TCEA1, TCEA3, TCEAL1, TCEB3, TCERG1, TCF12, TCF15, TCF19, TCF20, TCF21, TCF21, TCF3, TCF4, TCF7, TCF7L2, TCFAP2A, TCFAP2B, TCFAP2C, TCFCP2L1, TCFE2A, TCFE3, TCFEB, TCFEC, TCFL5, TEAD1, TEAD2, TEAD3, TEAD4, TEF, TFAP2A, TFAP2C, TFCP2L1, TFDP2, TFEB, TFEC, TGFB1I1, TGIF1, TGIF2, TGIF2LX, THRA, THRAP3, THRB, THRSP, TIAL1, TLE1, TLE6, TMEM131, TMPO, TNFAIP3, TOB1, TOX4, TP63, TRERF1, TRIB3, TRIM24, TRIM28, TRIM30, TRIP13, TRIP4, TRIP6, TRP53, TRP53BP1, TRP63, TRPS1, TRPS1, TSC22D1, TSC22D2, TSC22D3, TSC22D4, TSHZ1, TSHZ1, TSHZ3, TTRAP, TUB, TULP4, TWIST1, TWIST2, TYSND1, UBE2W, UBN1, UBP1, UBTF, UGP2, UHRF1, UHRF2, UNCX, USF1, USF2, UTF1, VDR, VEZF1, VGLL2, VSX1, WASL, WHSC1, WHSC2, WT1, WWP1, WWTR1, XBP1, YAF2, YY1, ZBED1, ZBED4, ZBTB1, ZBTB10, ZBTB16, ZBTB16, ZBTB17, ZBTB2, ZBTB20, ZBTB22, ZBTB25, ZBTB32, ZBTB38, ZBTB4, ZBTB43, ZBTB45, ZBTB47, ZBTB7A, ZBTB7B, ZBTB7C, ZCCHC8, ZDHHC13, ZDHHC16, ZDHHC21, ZDHHC5, ZDHHC6, ZEB2, ANK2ZEB2, ZFHX2, ZFHX3, ZFHX4, ZFP105, ZFP110, ZFP143, ZFP148, ZFP161, ZFP192, ZFP207, ZFP219, ZFP238, ZFP263, ZFP275, ZFP277, ZFP281, ZFP287, ZFP292, ZFP35, ZFP354C, ZFP36, ZFP36L1, ZFP386, ZFP407, ZFP42, ZFP423, ZFP426, ZFP445, ZFP451, ATF5ZFP451, ZFP467, ZFP52, ZFP57, ZFP592, ZFP593, ZFP597, ZFP612, ZFP637, ZFP64, ZFP647, ZFP748, ZFP810, ZFP9, ZFP91, ZFPM1, ZFPM2, ZFX, ZHX2, ZHX3, ZIC1, ZIC2, ZIC3, ZIC4, ZIC5, ZKSCAN1, ZKSCAN3, ZMYND11, ZNF143, ZNF160, ZNF175, ZNF184, ZNF192, ZNF213, ZNF217, ZNF219, ZNF22, ZNF238, ZNF24, ZNF267, ZNF273, ZNF276, ZNF280D, ZNF281, ZNF292, ZNF311, ZNF331, ZNF335, ZNF337, ZNF33B, ZNF366, ZNF394, ZNF398, ZNF41, ZNF410, ZNF415, ZNF423, ZNF436, ZNF444, ZNF445, ZNF451, ZNF460, ZNF496, ZNF498, ZNF516, ZNF521, ZNF532, ZNF536, ZNF546, ZNF552, ZNF563, ZNF576, ZNF580, ZNF596, ZNF621, ZNF628, ZNF648, ZNF649, ZNF652, ZNF655, ZNF664, ZNF668, ZNF687, ZNF692, ZNF696, ZNF697, ZNF710, ZNF80, ZNF91, ZNF92, ZNRD1, ZSCAN10, ZSCAN16, ZSCAN20, ZSCAN21, ZXDC, and ZZZ3. Additional examples of transcriptional regulators are as described above. Non-limiting examples of transcription factors (transcriptional activators; transcriptional repressors) set forth in SEQ ID Nos: 164-210. For example, a transcription factor can comprise an amino acid sequence having at least 75%, at least 80%, at least 85%, at least 90%, at least 95%, at least 98%, at least 99%, or 100%, amino acid sequence identity to the amino acid sequence depicted in SEQ ID Nos: 164-210.

In some cases, activation (e.g., phosphorylation; release) of the intracellular domain modulates expression of an endogenous gene of the cell through transcriptional regulation, chromatin regulation, translation, trafficking or post-translational processing. In some cases, activation (e.g., phosphorylation; release) of the intracellular domain modulates cellular adhesion of the cell to a second cell or to an extracellular matrix.

Binding-Transducer

The binding-transducer can comprise a ligand-inducible proteolytic cleavage site, where binding of the first member of the specific binding pair to the second member of the specific binding pair induces cleavage of the binding-transducer at the ligand-inducible proteolytic cleave site, thereby transducing the binding signal and activating the intracellular domain by proteolytically releasing the intracellular domain Examples of proteolytic cleavage sites in a synNotch are as described above.

As other examples, the proteolytic cleavage site can be, e.g., a metalloproteinase cleavage site, e.g., a cleavage site for a MMP selected from collagenase-1, -2, and -3 (MMP-1, -8, and -13), gelatinase A and B (MMP-2 and -9), stromelysin 1, 2, and 3 (MMP-3, -10, and -11), matrilysin (MMP-7), and membrane metalloproteinases (MT1-MMP and MT2-MMP). For example, the cleavage sequence of MMP-9 is Pro-X-X-Hy (wherein, X represents an arbitrary residue; Hy, a hydrophobic residue), e.g., Pro-X-X-Hy-(Ser/Thr), e.g., Pro-Leu/Gln-Gly-Met-Thr-Ser (SEQ ID NO:101) or Pro-Leu/Gln-Gly-Met-Thr (SEQ ID NO:102). Another example of a protease cleavage site is a plasminogen activator cleavage site, e.g., a uPA or a tissue plasminogen activator (tPA) cleavage site. Another example of a suitable protease cleavage site is a prolactin cleavage site. Specific examples of cleavage sequences of uPA and tPA include sequences comprising Val-Gly-Arg. Another example of a protease cleavage site that can be included in a proteolytically cleavable linker is a tobacco etch virus (TEV) protease cleavage site, e.g., ENLYTQS (SEQ ID NO:103), where the protease cleaves between the glutamine and the serine. Another example of a protease cleavage site that can be included in a proteolytically cleavable linker is an enterokinase cleavage site, e.g., DDDDK (SEQ ID NO:104), where cleavage occurs after the lysine residue. Another example of a protease cleavage site that can be included in a proteolytically cleavable linker is a thrombin cleavage site, e.g., LVPR (SEQ ID NO:105). Additional suitable linkers comprising protease cleavage sites include linkers comprising one or more of the following amino acid sequences: LEVLFQGP (SEQ ID NO:106), cleaved by PreScission protease (a fusion protein comprising human rhinovirus 3C protease and glutathione-S-transferase; Walker et al. (1994) *Biotechnol.* 12:601); a thrombin cleavage site, e.g., CGLVPAGSGP (SEQ ID NO:107); SLLKSRMVPNFN (SEQ ID NO:108) or SLLIARRMPNFN (SEQ ID NO:109), cleaved by cathepsin B; SKLVQASASGVN (SEQ ID NO:110) or SSYLK-ASDAPDN (SEQ ID NO:111), cleaved by an Epstein-Barr virus protease; RPKPQQFFGLMN (SEQ ID NO:112) cleaved by MMP-3 (stromelysin); SLRPLALWRSFN (SEQ ID NO:113) cleaved by MMP-7 (matrilysin); SPQ-GIAGQRNFN (SEQ ID NO:114) cleaved by MMP-9; DVDERDVRGFASFL SEQ ID NO: 115) cleaved by a thermolysin-like MMP; SLPLGLWAPNFN (SEQ ID NO:116) cleaved by matrix metalloproteinase 2(MMP-2); SLLIFRSWANFN (SEQ ID NO:117) cleaved by cathespin L; SGVVIATVIVIT (SEQ ID NO:118) cleaved by cathepsin D; SLGPQGIWGQFN (SEQ ID NO:119) cleaved by matrix metalloproteinase 1(MMP-1); KKSPGRVVGGSV (SEQ ID NO:120) cleaved by urokinase-type plasminogen activator; PQGLLGAPGILG (SEQ ID NO:121) cleaved by membrane type 1 matrixmetalloproteinase (MT-MMP); HGPEGLRVGFYESDVMGRGHARLVHVEEPHT (SEQ ID NO:122) cleaved by stromelysin 3 (or MMP-11), thermolysin, fibroblast collagenase and stromelysin-1; GPQGLAGQRGIV (SEQ ID NO:123) cleaved by matrix metalloproteinase 13 (collagenase-3); GGSGQRGRKALE (SEQ ID NO:124) cleaved by tissue-type plasminogen activator(tPA); SLSALLSSDIFN (SEQ ID NO:125) cleaved by human prostate-specific antigen; SLPRFKIIGGFN (SEQ ID NO:126) cleaved by kallikrein (hK3); SLLGIAVPGNFN (SEQ ID NO:127) cleaved by neutrophil elastase; and FFKNIVTPRTPP (SEQ ID NO:128) cleaved by calpain (calcium activated neutral protease).

Cells

A method of the present disclosure can be used to modulate an activity of any eukaryotic cell. In some cases, the cell is in vivo. In some cases, the cell is ex vivo. In some cases, the cell is in vitro. In some cases, the cell is a mammalian cell. In some cases, the cell is a human cell. In some cases, the cell is a non-human primate cell. In some cases, the cell is rodent cell. In some cases, the cell is mouse cell. In some cases, the cell is a rat cell.

Suitable cells include retinal cells (e.g., Müller cells, ganglion cells, amacrine cells, horizontal cells, bipolar cells, and photoreceptor cells including rods and cones, Müller glial cells, and retinal pigmented epithelium); neural cells (e.g., cells of the thalamus, sensory cortex, zona incerta (ZI), ventral tegmental area (VTA), prefontal cortex (PFC), nucleus accumbens (NAc), amygdala (BLA), substantia nigra, ventral pallidum, globus pallidus, dorsal striatum, ventral striatum, subthalamic nucleus, hippocampus, dentate gyrus, cingulate gyrus, entorhinal cortex, olfactory cortex, primary motor cortex, or cerebellum); liver cells; kidney cells; immune cells; cardiac cells; skeletal muscle cells; smooth muscle cells; lung cells; and the like.

Suitable cells include a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplated expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg).

In some cases, the cell is a stem cell. In some cases, the cell is an induced pluripotent stem cell. In some cases, the cell is a mesenchymal stem cell. In some cases, the cell is a hematopoietic stem cell. In some cases, the cell is an adult stem cell.

Suitable cells include bronchioalveolar stem cells (BASCs), bulge epithelial stem cells (bESCs), corneal epithelial stem cells (CESCs), cardiac stem cells (CSCs), epidermal neural crest stem cells (eNCSCs), embryonic stem cells (ESCs), endothelial progenitor cells (EPCs), hepatic oval cells (HOCs), hematopoetic stem cells (HSCs), keratinocyte stem cells (KSCs), mesenchymal stem cells (MSCs), neuronal stem cells (NSCs), pancreatic stem cells (PSCs), retinal stem cells (RSCs), and skin-derived precursors (SKPs)

In some cases, the stem cell is a hematopoietic stem cell (HSC), and the transcription factor induces differentiation of the HSC to differentiate into a red blood cell, a platelet, a lymphocyte, a monocyte, a neutrophil, a basophil, or an eosinophil. In some cases, the stem cell is a mesenchymal stem cell (MSC), and the transcription factor induces differentiation of the MSC into a connective tissue cell such as a cell of the bone, cartilage, smooth muscle, tendon, ligament, stroma, marrow, dermis, or fat.

Kits

The present disclosure provides a kit for carrying out a method of modulating the activity of a cell.

In some cases, a subject kit comprises an expression vector comprising a nucleotide sequence encoding a chimeric Notch receptor polypeptide of the present disclosure. In some cases, a subject kit comprises a chimeric Notch receptor polypeptide of the present disclosure.

In some cases, a subject kit comprises a host cell that is genetically modified with a nucleic acid comprising a nucleotide sequence encoding a chimeric Notch receptor polypeptide of the present disclosure. In some cases, a subject kit comprises a host cell that is genetically modified with a recombinant expression vector comprising a nucleotide sequence encoding a chimeric Notch receptor polypeptide of the present disclosure. Kit components can be in the same container, or in separate containers.

Any of the above-described kits can further include one or more additional reagents, where such additional reagents can be selected from: a dilution buffer; a reconstitution solution; a wash buffer; a control reagent; a control expression vector; a negative control polypeptide (e.g., a chimeric Notch receptor polypeptide that lacks the one or more ligand-inducible proteolytic cleavage sites, such that, upon binding of the first member of the specific binding to the second member of the specific binding pair, the intracellular domain is not released); a positive control polypeptide; a reagent for in vitro production of the chimeric Notch receptor polypeptide, and the like.

In addition to above-mentioned components, a subject kit can further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1: Generation and Characterization of Chimeric Notch Receptor Polypeptides Materials and Methods Jurkat T cells were stably transduced via lentivirus with a Tet response element (TRE) anti-Mesothelin CAR-EGFP/pGK mCherry dual vector. Transduced cells constitutively expressed mCherry and inducibly expressed the anti-Mesothelin CAR-EGFP fusion in the presence of the Tet transactivator (tTa). This stable line was then transduced with the anti-CD19 Notch tTA receptor. The resultant Jurkat cells were then assayed via co-culturing with Chronic Myeloid Leukemia K562 cancer cells expressing the antigens CD19, Mesothelin, or both. The T cells were assessed at 24 hrs by flow cytometry for expression of the EGFP tagged CAR and the activation marker, CD69. The co-culture supernatant was also collected and secretion of IL-2 was determined by ELISA.

Results

Chimeric Notch Receptor Characterization

Figure 30A:
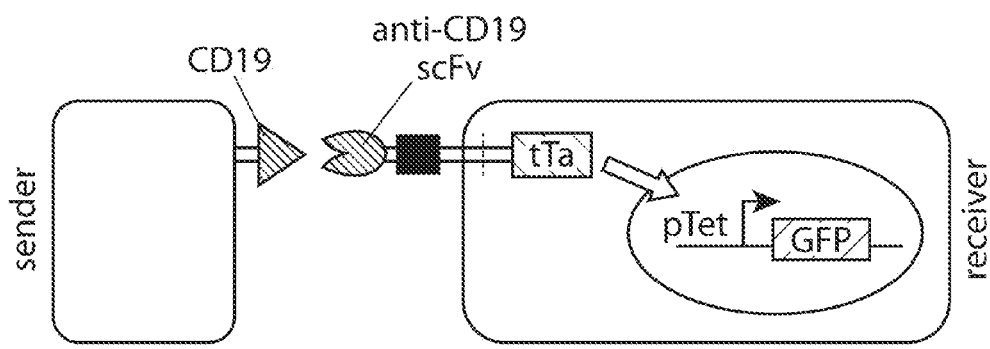
FIGS. 30A and 30B depict representative results for the Chimeric Notch with anti-CD19 in the TRE reporter line.
Figure 30B:
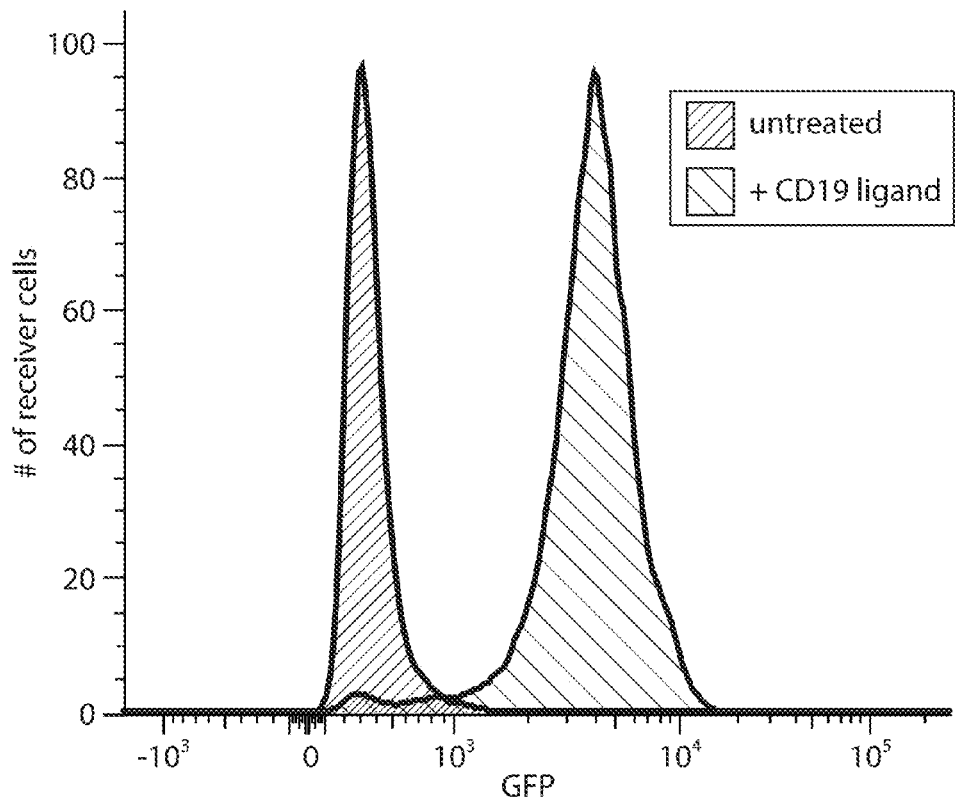
Figure 31A:
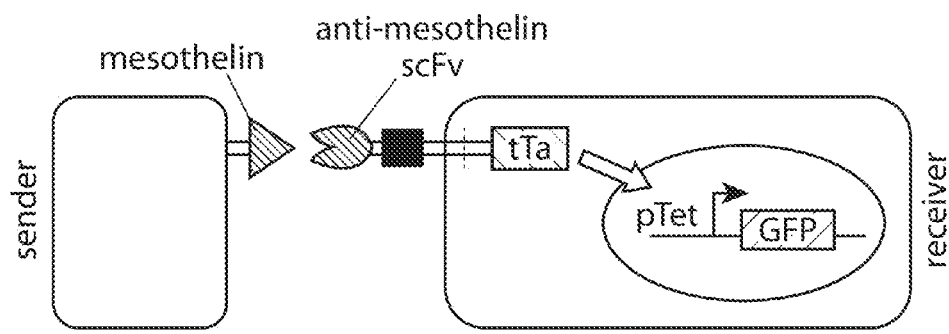
FIGS. 31A and 31B depict representative results for the Chimeric Notch with anti-mesothelin in the TRE reporter line.
Figure 31B:
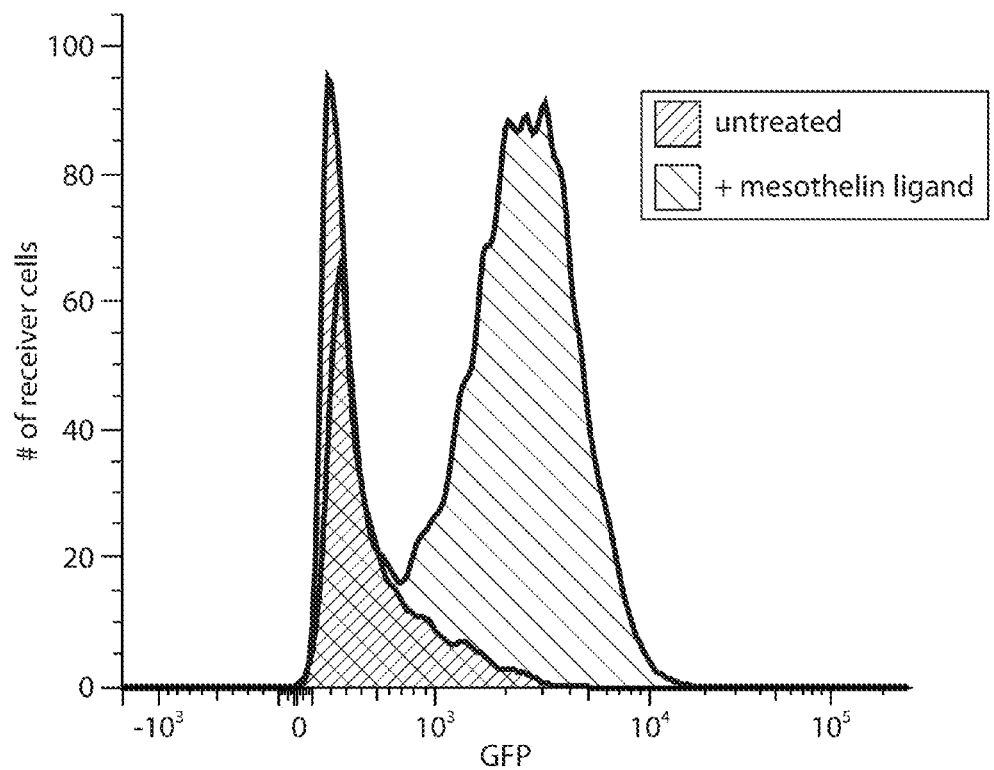
Figure 32A:
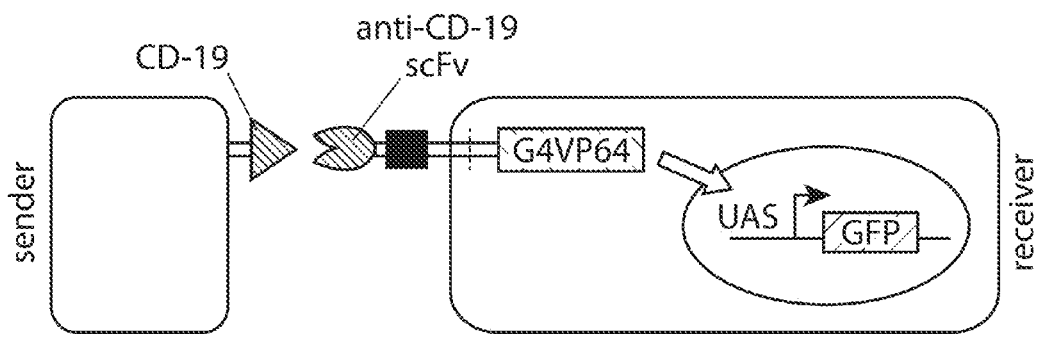
FIGS. 32A and 32B depict representative results for the Chimeric Notch anti-CD19 in the UAS reporter line.
Figure 32B:
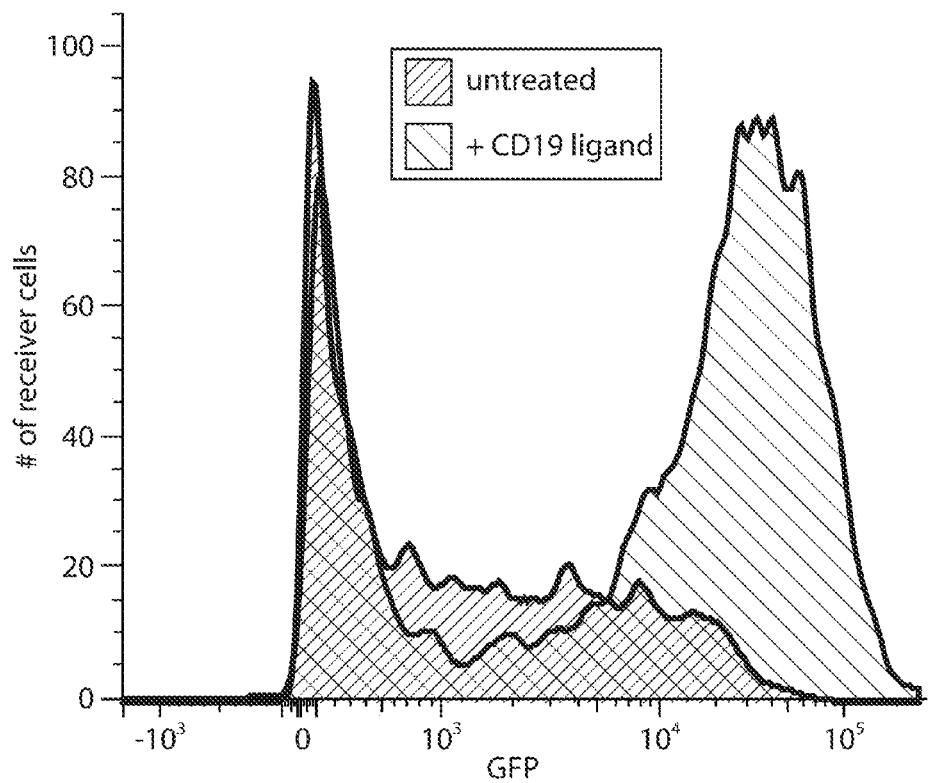

To show that the Chimeric Notch platform could be used to induce transcription in receiver cells upon ligand binding, the following reporter cell lines were generated: mouse L929 fibroblasts reporter lines were generated by transduction with a Tet response element (TRE)→EGFP reporter/pGK mCherry dual vector (TRE reporter) or a Gal4 UAS→EGFP/pGK puromycin resistance dual vector (UAS reporter). The Chimeric Notch variants were transduced into the corresponding L929 reporter cell line, to generate Chimeric Notch reporter cells. These Chimeric Notch reporter cells were stimulated in parallel by two methods. First, the Chimeric Notch expressing cells were exposed to an immobilized antibody that bound specifically to the extracellular domain of the receptor. Second, the cells were incubated with K562 cells or L929 fibroblasts expressing the cognate Chimeric Notch ligand. The Chimeric Notch expressing cells were assayed for EGFP fluorescence by flow cytometry to measure reporter activity. FIGS. 30-32 show representative results for the Chimeric Notch with anti-CD19 (FIGS. 30A-B) and anti-mesothelin (FIG. 31A-B) in the TRE reporter line, and for the Chimeric Notch anti-CD19 for the UAS reporter line (FIG. 32A-B).

Figure 33A:
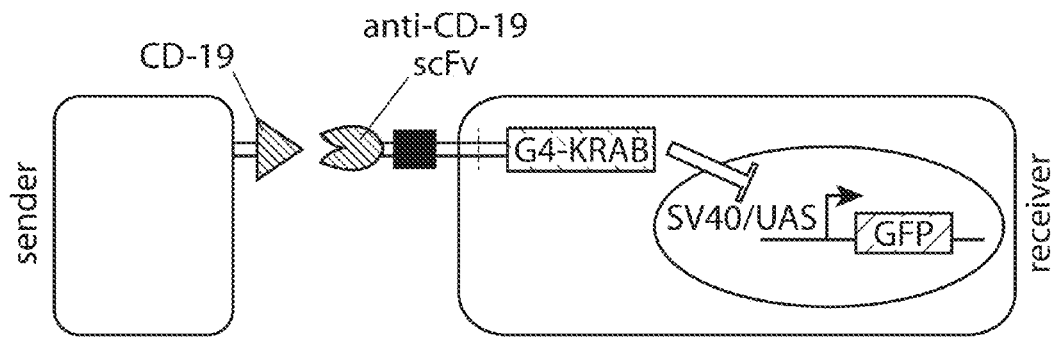
FIGS. 33A and 33B depict depicts results with SV40/UAS reporter cells transduced with the anti-CD19 Chimeric Notch in which the intracellular domain is a fusion of the Gal4 DNA-binding domain with the transcriptional repressor domain KRAB.
Figure 33B:
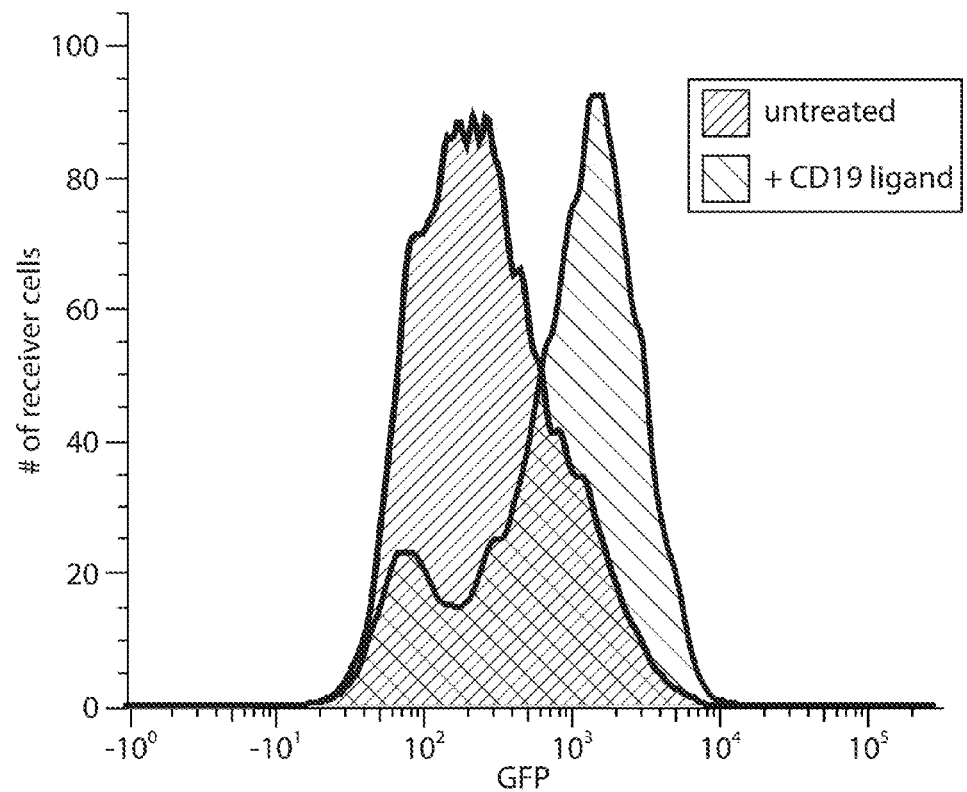

To show that the Chimeric Notch platform can be used to repress transcription, another reporter line was generated that expressed EGFP downstream of a composite SV40/UAS promoter (SV40/UAS reporter). FIG. 33A These SV40/UAS reporter cell line express GFP at high levels. These SV40/UAS reporter cells were transduced with the anti-CD19 Chimeric Notch in which the intracellular domain is a fusion of the Gal4 DNA-binding domain with the transcriptional repressor domain KRAB. As shown in FIG. 33B, untreated Chimeric Notch SV40/UAS reporter cells display high EGFP expression; in the presence of the ligand for the Chimeric Notch receptor, the EGFP expression is down-regulated.

Figure 34:
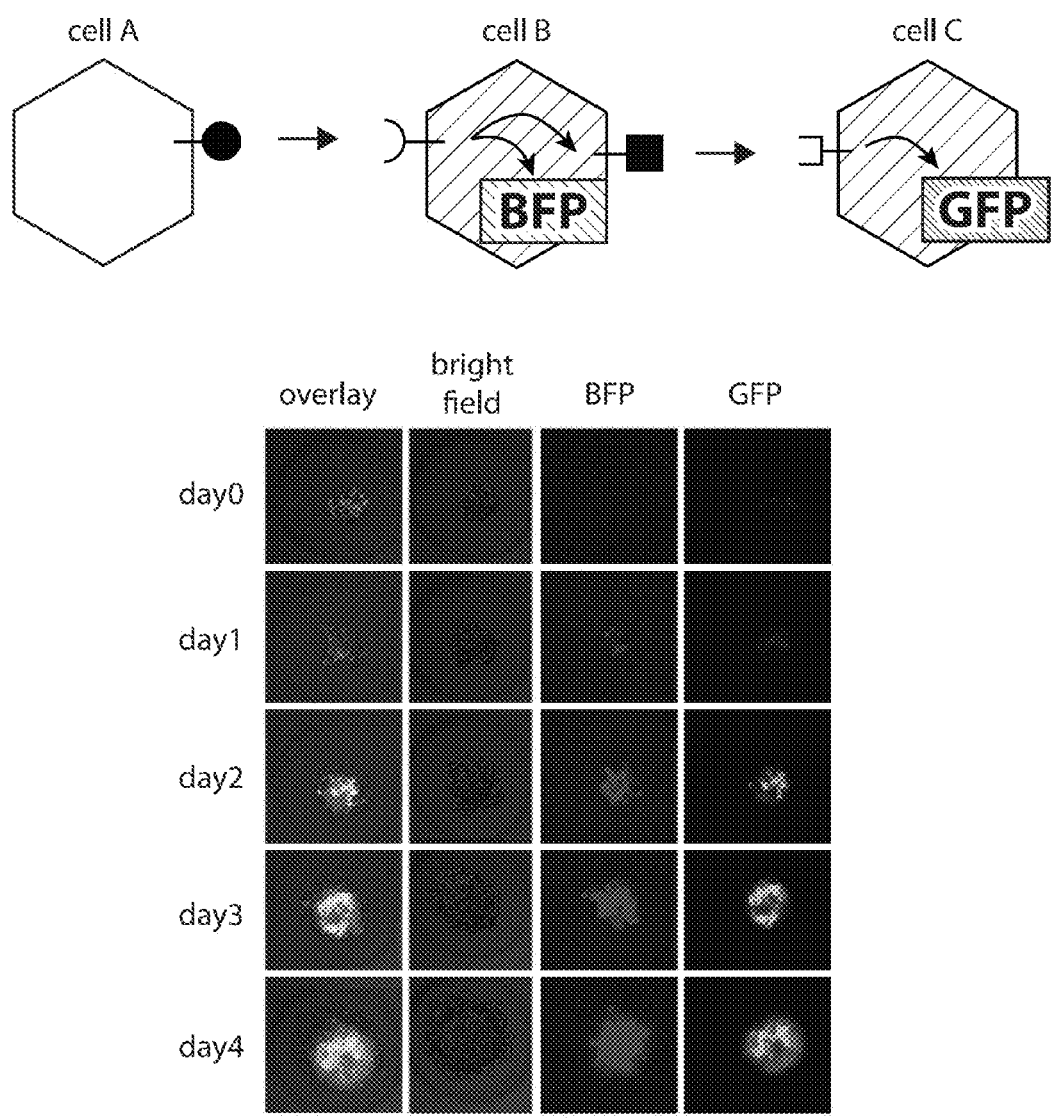
FIG. 34 depicts use of chimeric Notch receptor polypeptides in a cascade of signaling relay.

To show that a cascade of signaling relay can be built, a cascade of multiple Chimeric Notch polypeptides was designed in the following way. Cells A express the first ligand A (mesothelin). Cells B express the Chimeric Notch with anti-mesothelin scFv as extracellular domain and tTA as intracellular domain; cells B also express the second ligand, CD19, and a blue fluorescent protein (BFP) under the control of a TRE sequence. Cells C express the anti-CD19 Chimeric Notch with tTA as intracellular domain; moreover, cells C express GFP controlled by a TRE sequence. FIG. 34 shows a time course of microscope pictures of one representative aggregate of cells A+cells B+cells C. Cells B, activated by the ligand expressed by cells A, induce expression of BFP and CD19 at day 1 of cultivation; CD19 from cells B in turn induces expression of GFP in cells C starting from day 2.

Chimeric Notch Gates Chimeric Antigen Receptor Expression and T Cell Activation to Cancer Cells T cells engineered to express artificial T cell receptors known as Chimeric Antigen receptors (CAR) are effective as therapeutics for certain B cell cancers. However, a major concern with CAR T cell cancer immunotherapy is off-target effects, where the therapeutic T cells destroy normal tissue leading to serious side effects and even death. A potential strategy to mitigate such problems is for therapeutic T cells to only express the CAR when in the tumor microenvironment providing more localized T cell responses. To implement such a strategy, it was reasoned that Chimeric Notch could be used in therapeutic T cells to first detect the tumor by binding a tumor-specific cell surface antigen and initiate expression of a CAR to a second tumor-specific antigen only in the tumor. Effectively, this provides both dual antigen control over T cell activity and a tumor-localized response. Proof of principal in vitro data are presented in Jurkat cells.

Figure 35A:
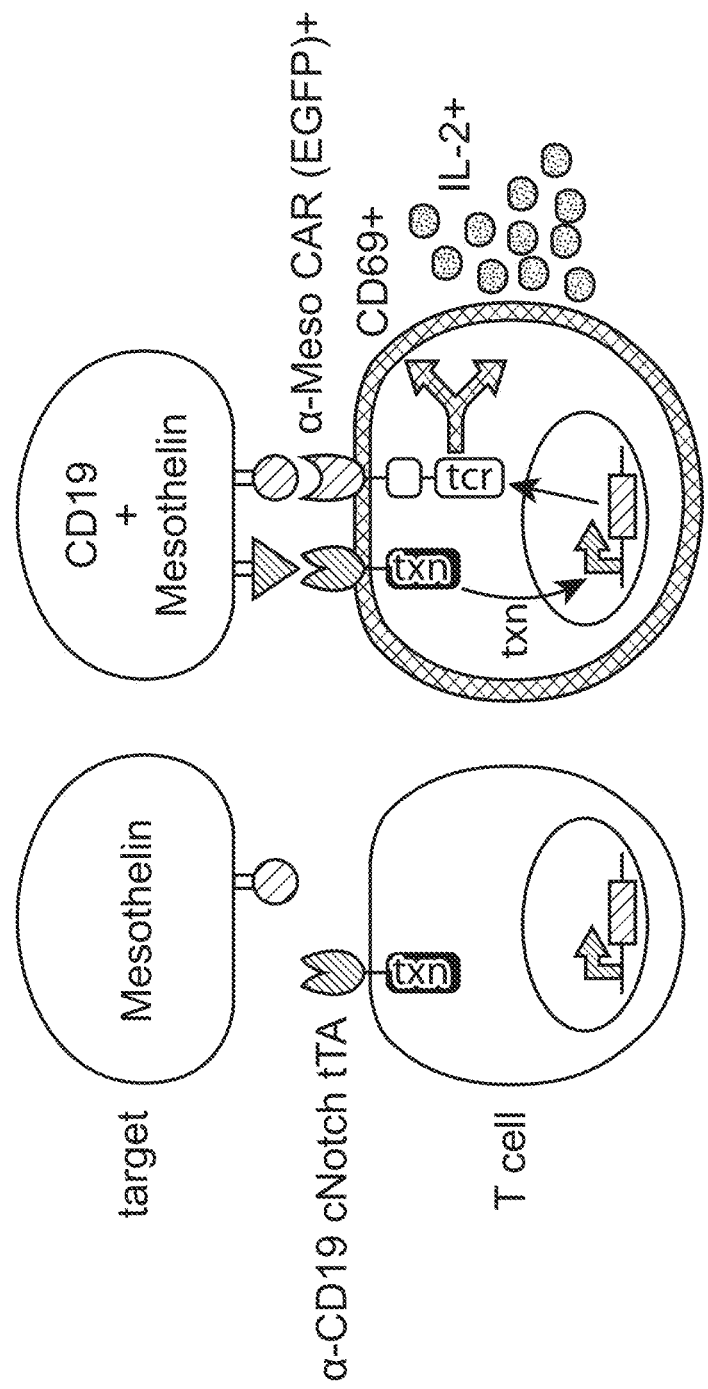
FIG. 35A-35C depicts the effect of a chimeric Notch receptor polypeptide on Chimeric Antigen Receptor (CAR) expression and T cell activation to cancer cells.

Jurkat T cells that express the CD19scFv Chimeric Notch tTA equipped with a TRE driving the expression of a Mesothelin scFv CAR-EGFP were exposed to Mesothelin+ or CD19/Mesothelin+ K562 cancer cells and CAR expression and T cell activation was assessed at 24 hours (FIG. 35A). Upregulation of the activation marker, CD69, and IL-2 secretion were used as indicators of T cell activation. The Chimeric Notch engineered T cells only expressed the CAR and activated when exposed to cancer cells expressing both antigens (FIG. 35B-C).

Figure 35B:
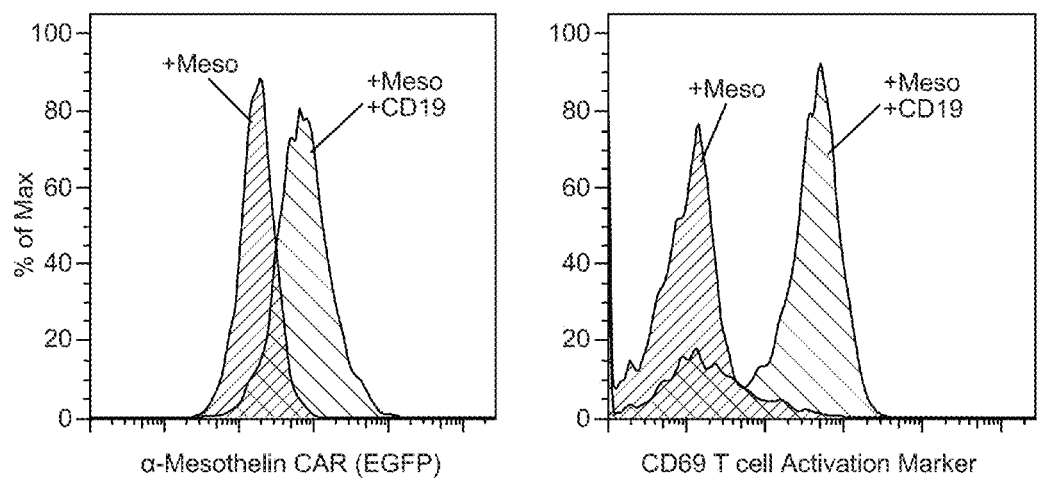
Figure 35C:
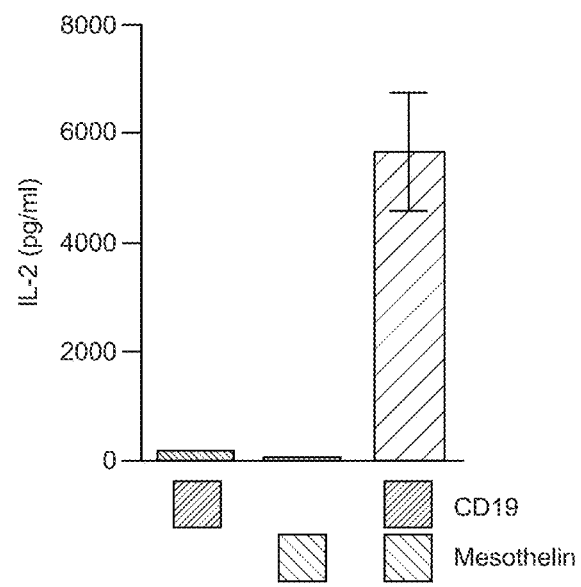

FIGS. 35A-C. Chimeric Notch Gates Chimeric Antigen Receptor Expression and T Cell Activation to Cancer Cells.

(A) Schematic of two-antigen control of T cell activation by anti-CD19 Chimeric Notch tTA gated expression of the anti-Mesothelin CAR. (B) Flow cytometry analysis CAR-GFP expression (left panel) and CD69 levels (right panel) of Jurkat T cells that express the CD19scFV Chimeric Notch tTA equipped with a TRE driving the expression of a Mesothelin scFv CAR-EGFP after exposure to K562 cancer cells positive for the indicated antigens. (C) IL-2 levels in the co-culture supernatant from the same experiment described in panel B.

Example 2: Gamma Secretase Protease Activity and Chimeric Notch Signaling

Figure 36A:
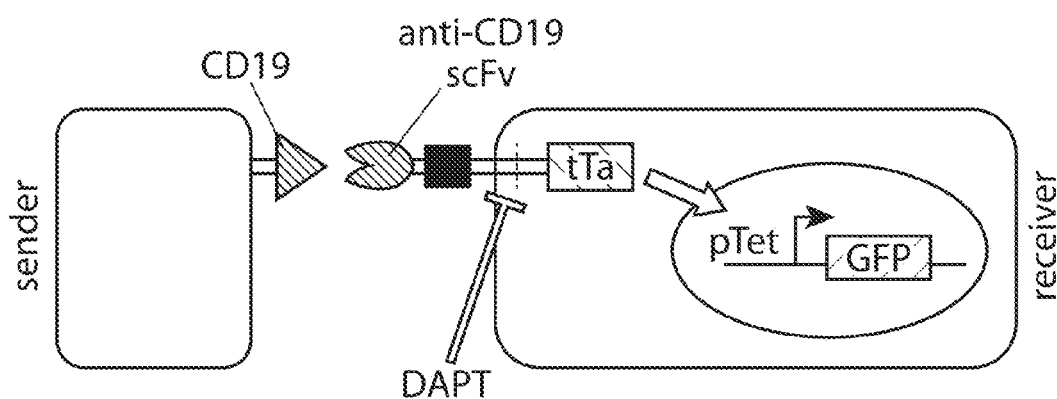
FIGS. 36A and 36B depict the effect of a γ-secretase inhibitor on activation of a chimeric Notch receptor polypeptide.
Figure 36B:
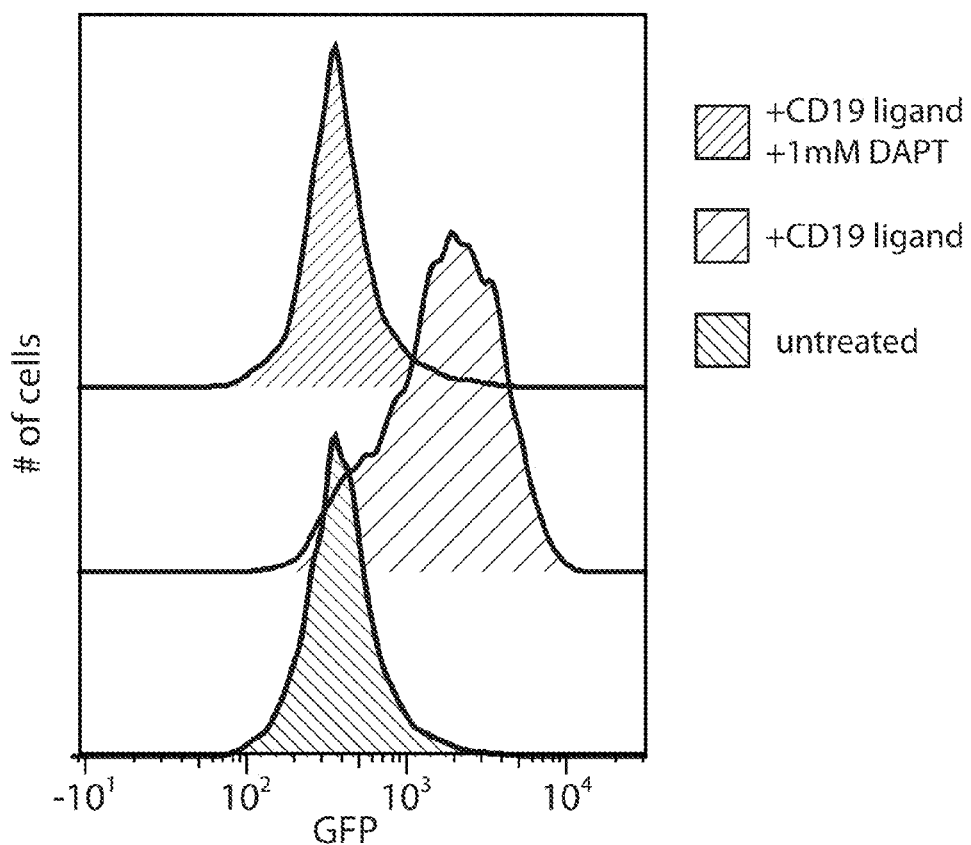

A "receiver" cell expressing a chimeric Notch polypeptide (comprising an anti-CD19 scFv as the extracellular polypeptide, and a tTA transcriptional activator as the intracellular domain), and including a pTet-GFP construct, as depicted in FIG. 30A and as described in Example 1, was contacted with a "sender" cell expressing CD19 on its surface, in the presence or absence of 1 mM N-[(3,5-Difluorophenyl)acetyl]-L-alanyl-2-phenyl]glycine-1,1-dimethylethyl ester (DAPT). DAPT is a gamma secretase inhibitor. The data are expressed as $GFP^+$ "receiver" cells. As shown in FIGS. 36A and 36B, in the presence of the sender cells and DAPT, $GFP^+$ "receiver" cells were at control, untreated levels; in the absence of DAPT, contact with the sender cells robustly activated the chimeric Notch polypeptide and expression of GFP.

Example 3: Synthetic Notch Receptors are a Modular Platform for Engineering Customized Cell Sensing and Response Behaviors A Minimal Notch Transmembrane Region can be Combined with Novel Extracellular and Intracellular Domains to Construct Diverse Chimeric Receptors.

Figure 37A:
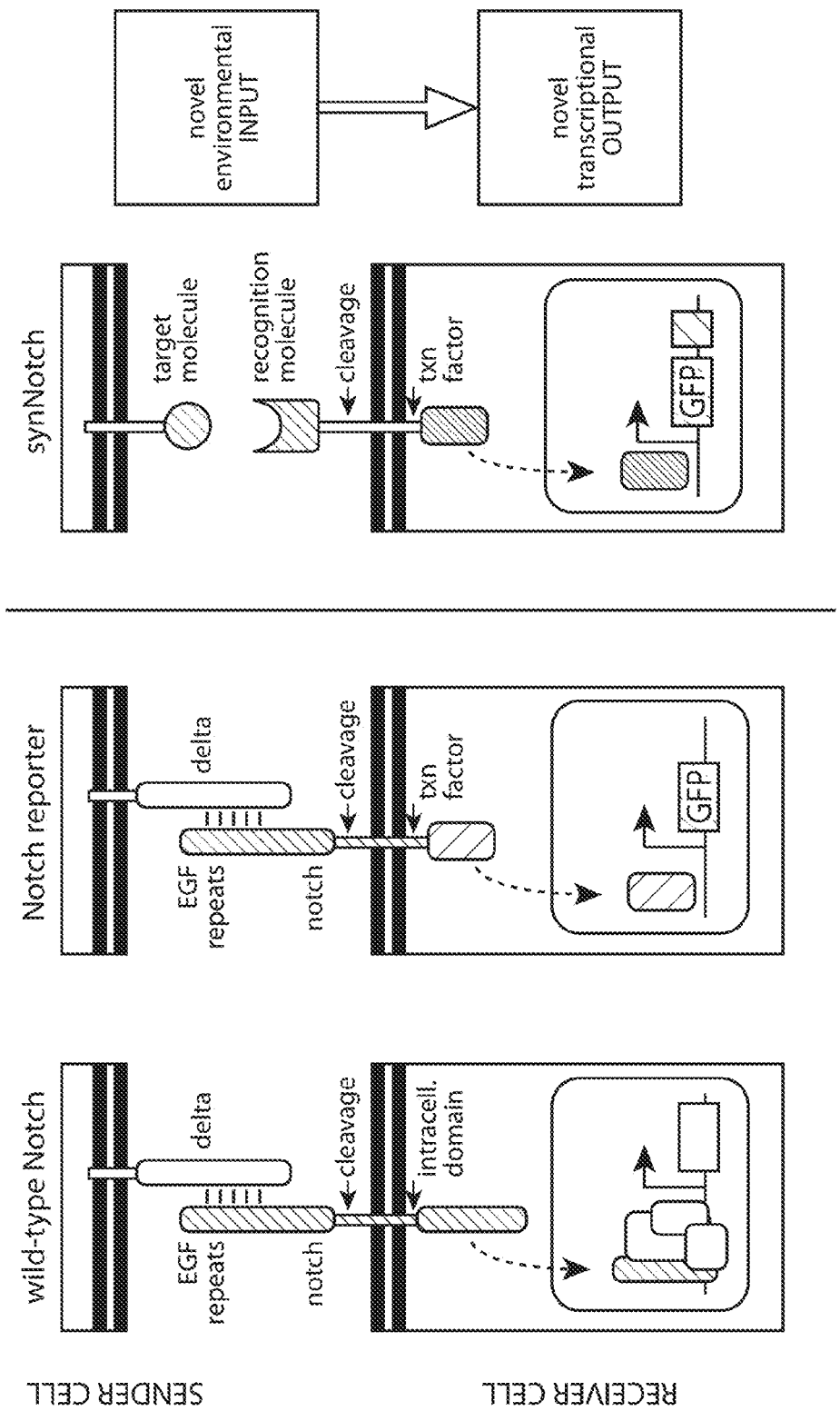
FIGS. 37A and 37B depict exemplary modular configurations of synNotch receptors.
Figure 37B:
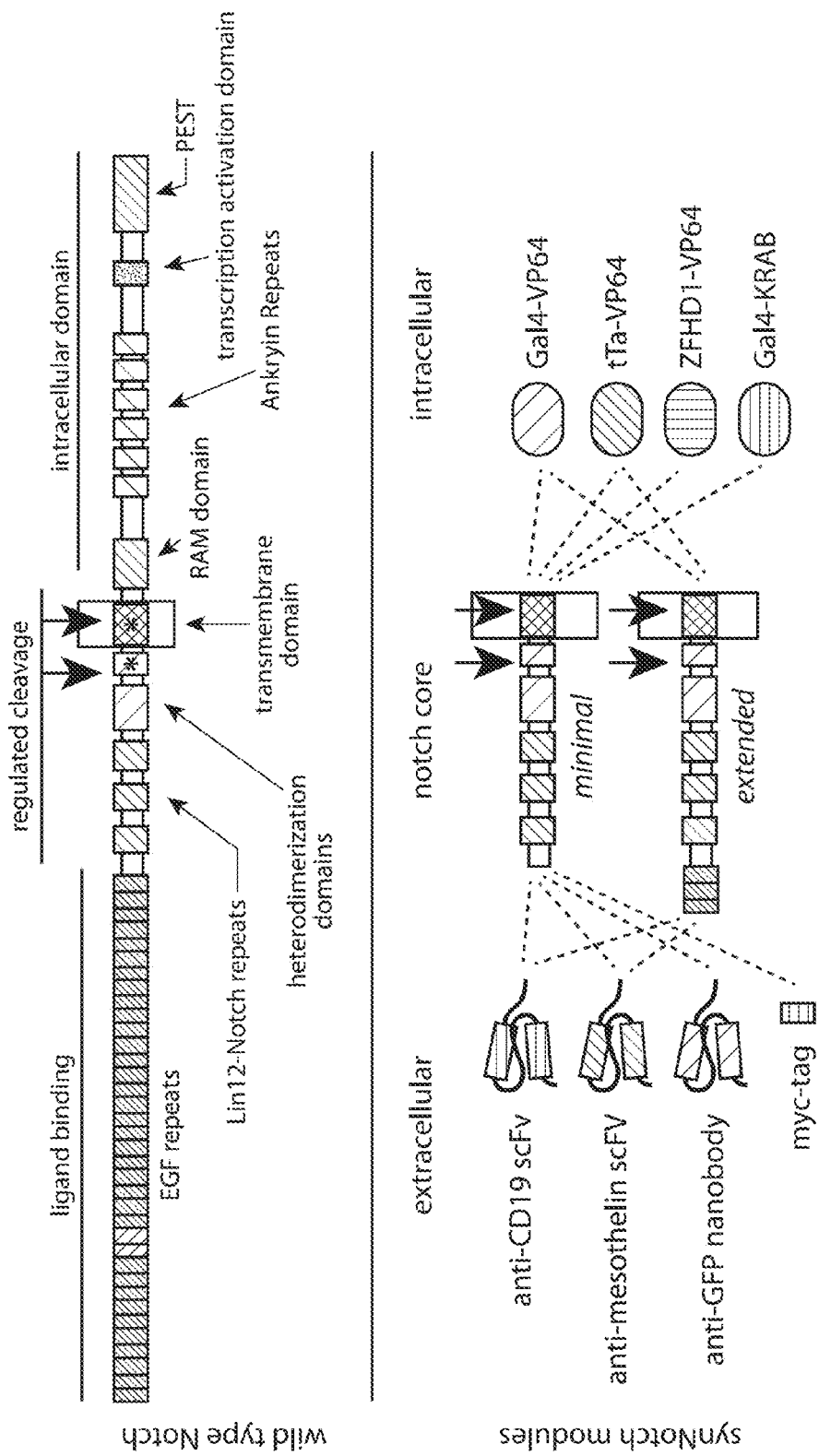
Figure 38A:
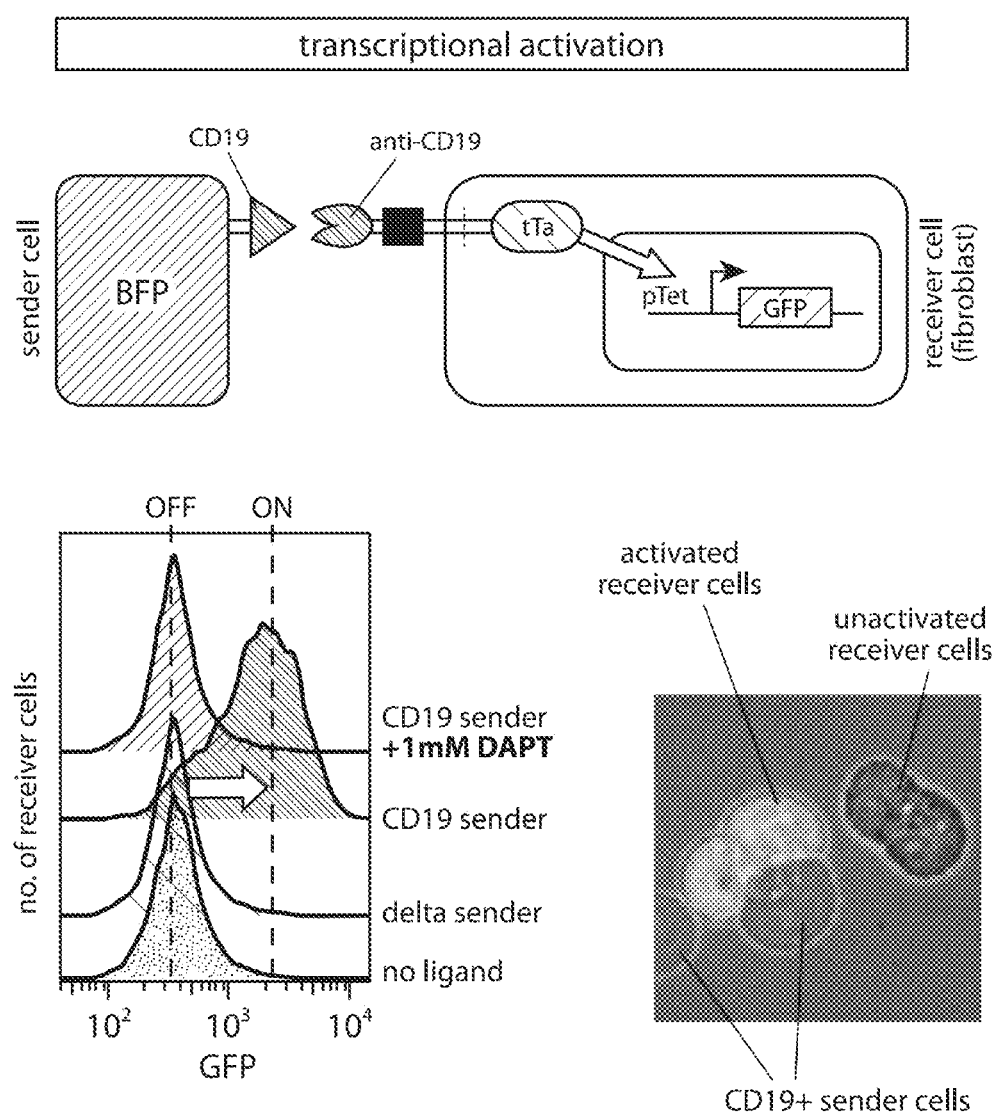
Figure 39A:
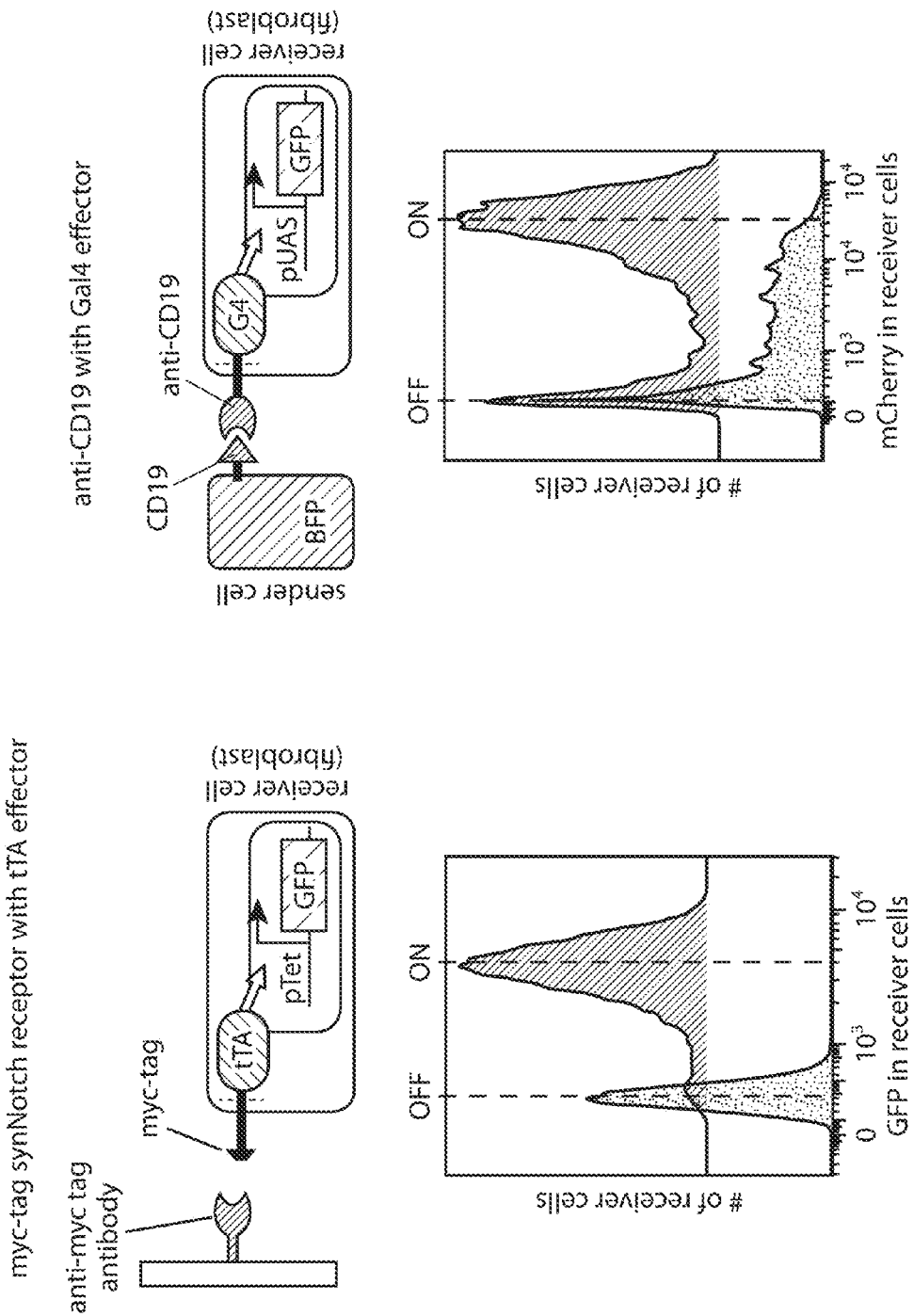
Figure 39A:
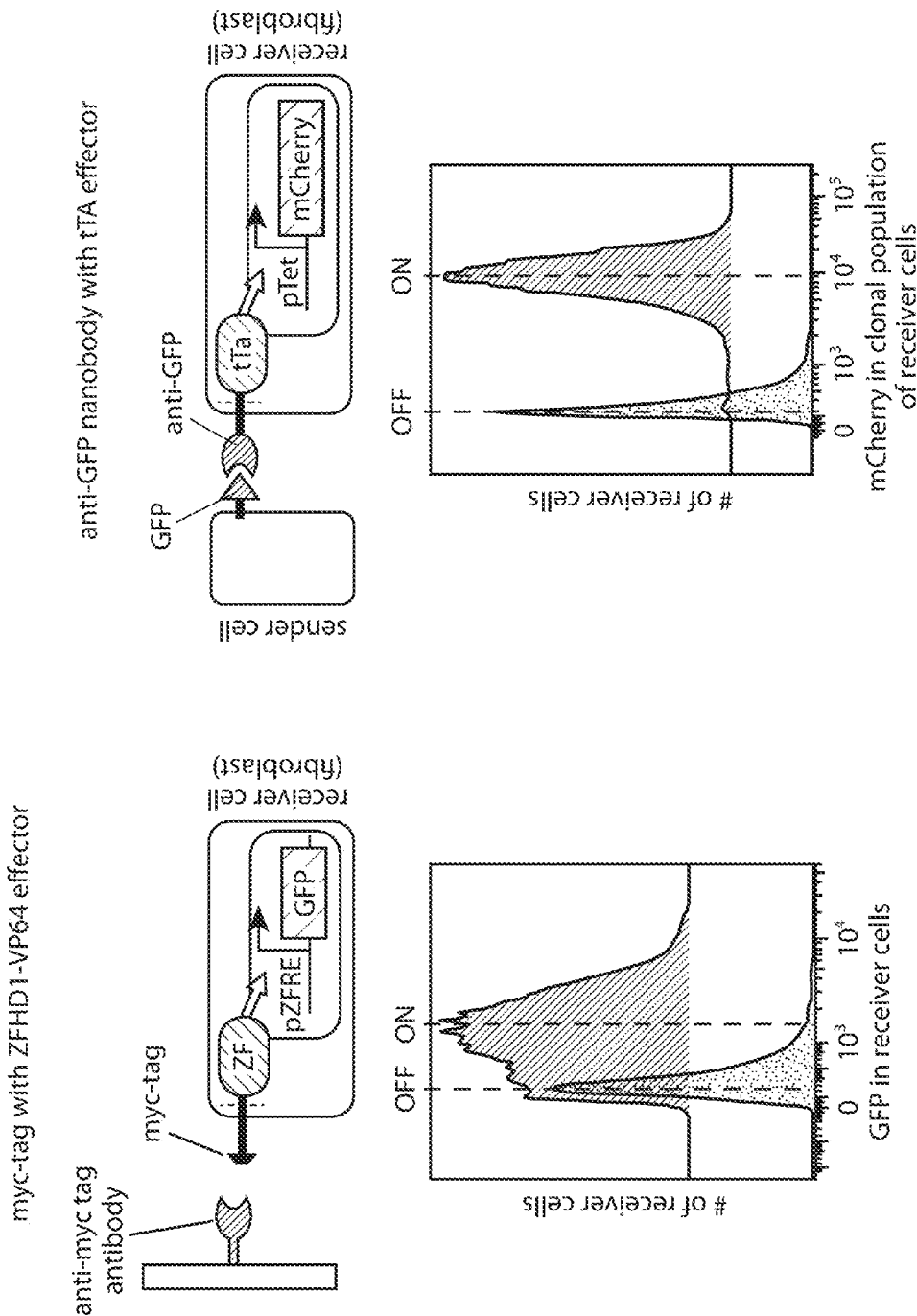
Figure 39A:
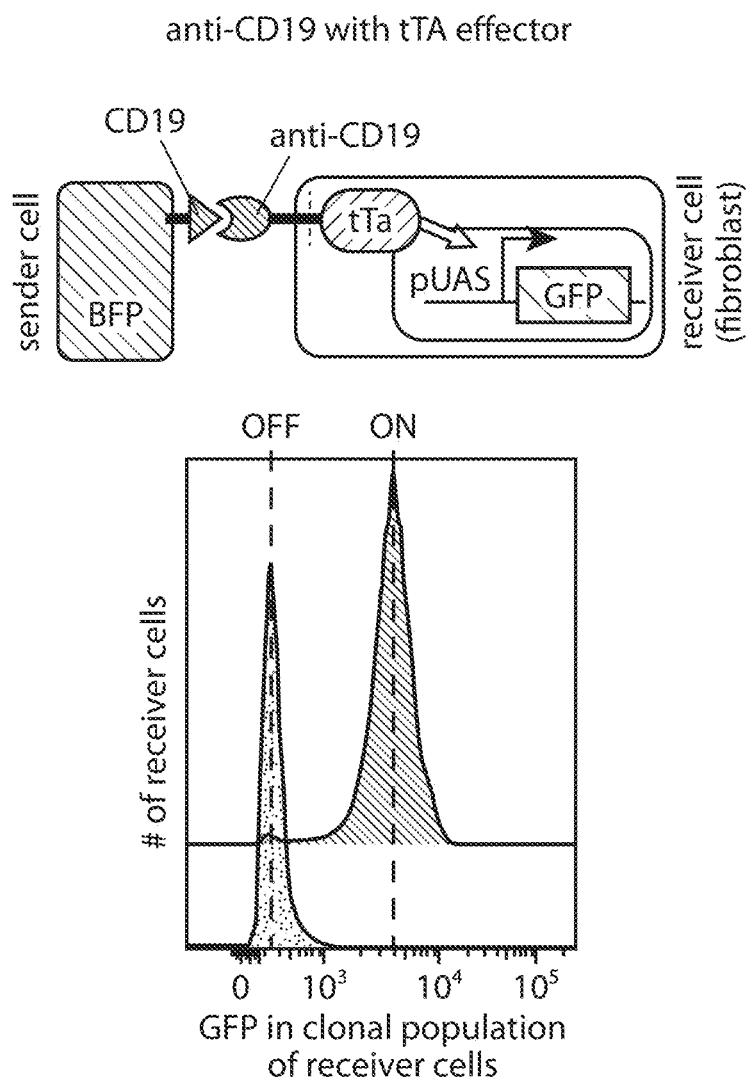

The core of the Notch transduction pathway is in the transmembrane region. This design can be the thought of as a platform for engineering a series of receptors that detect a diverse array of membrane-presented ligands (FIG. 37A). On the intracellular side, the Notch intracellular domain (NICD) can be replaced by orthogonal transcription factors, to report on Notch signaling activation. On the extracellular, the endogenous Delta binding domain can be replaced by protein binding domains (e.g. FKBP, anti-GFP nanobody, etc.) and cleavage is induced when the cognate binding partner is bound. Therefore, libraries of receptor molecules with different extracellular domains each coupled with a different intracellular domain were generated (FIG. 37B). As shown in FIG. 38A, the synthetic receptor response is activated by cell-cell contact with sender cells expressing the cognate ligand in a cleavage-dependent manner Results on different extracellular and intracellular domain combinations are provided in FIG. 39A.

Figure 39B:
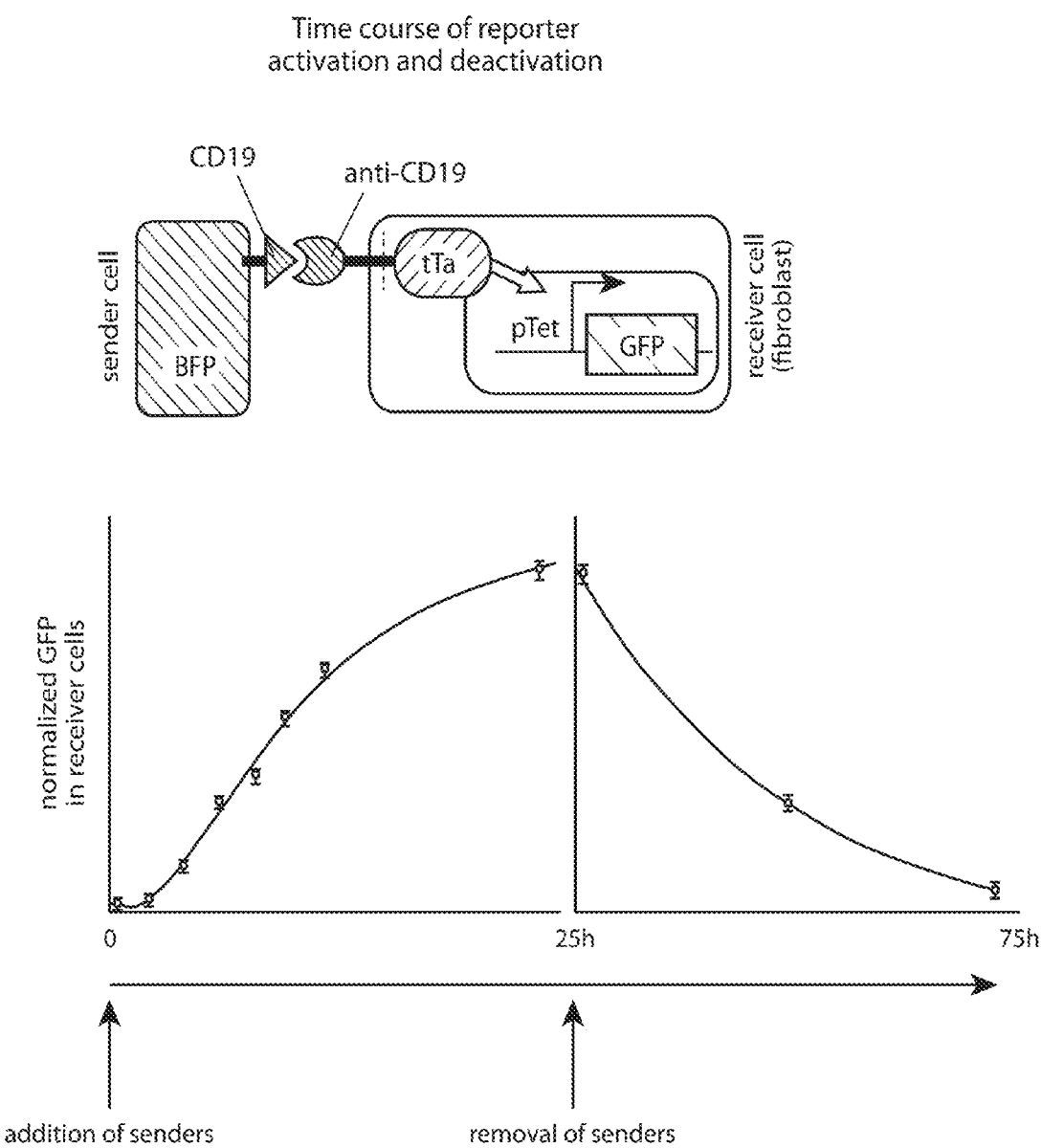
Figure 39D:
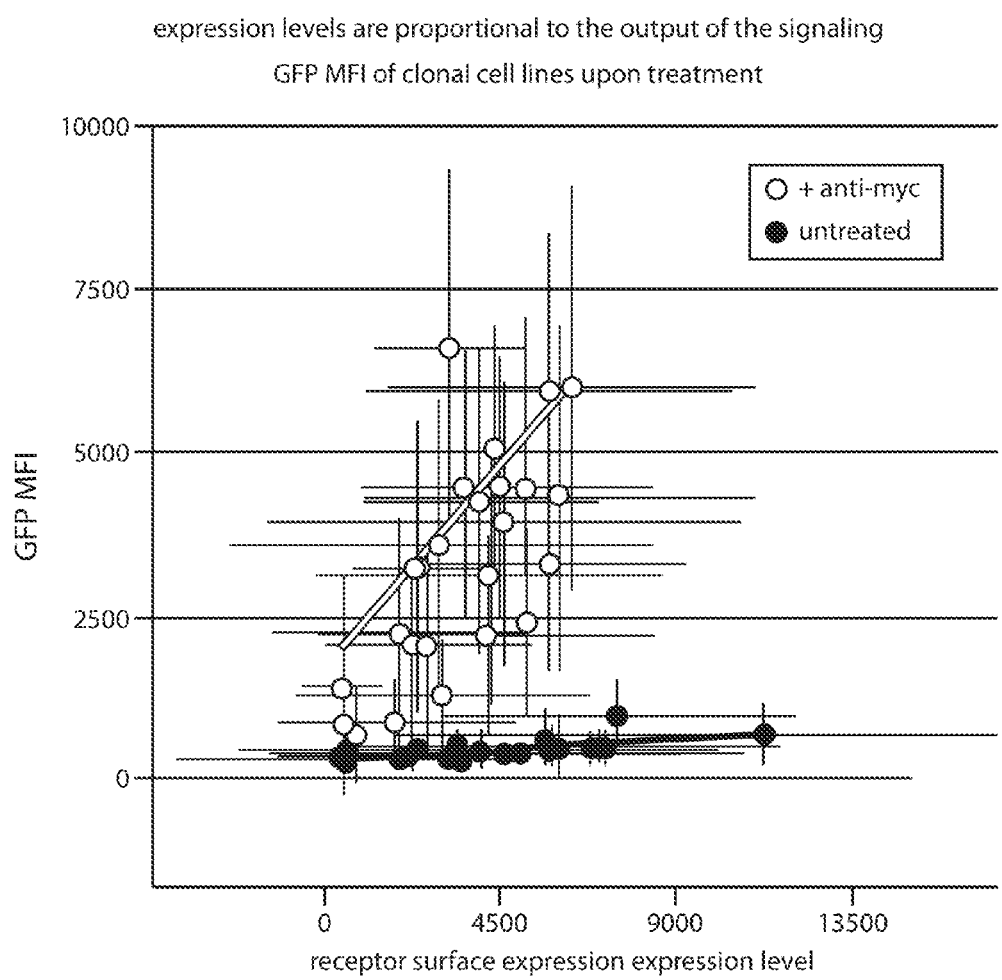
Figure 40A:
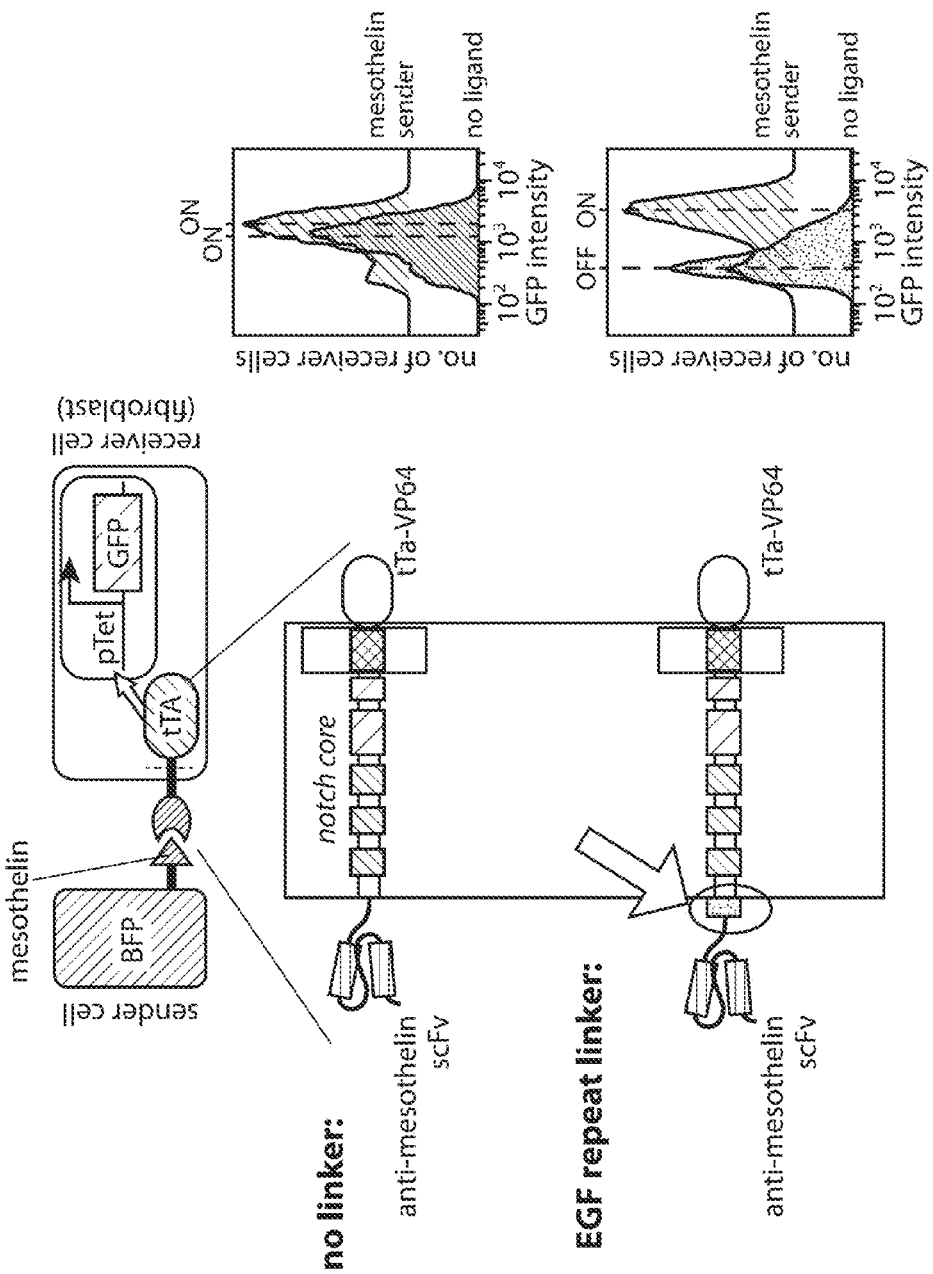

The activation of the synthetic receptor response is reversible upon removal of the ligand expressing cells, and the transcriptional response at 24 h can be activated by a pulse of stimulation as short as 1 h (FIG. 39B); moreover, the dose/response relationship between the ligand amount and the receptor activation is graded, replicating a feature of endogenous Notch signaling (FIG. 39C). The amount of receptor expressed by the cells correlates linearly with the strength of induction of the reporter (FIG. 39D). For certain extracellular domains, suboptimal background activity or poor inducibility were observed. It was discovered that, by slightly extending the regulated cleavage transmembrane region of the synthetic Notch to incorporate one or more EGF-repeats could sometimes improve synthetic receptor function. For example, synNotch molecules with an extracellular anti-mesothelin scFv displayed an improved threshold to activation when this extension was incorporated (FIG. 40A).

The GFP and the CD19 detecting synNotches were tested against ligand presented in different formats—soluble, cell-surface expressed, and cis cell surface expressed (i.e. on the same cell as the receptor) (FIG. 38C). It was found that the synNotches transduce the signal only when their ligand is presented on an opposing surface; no activation was detected when the cognate ligand was in solution or presented on the same surface as the receptor (cis). Interestingly, when the ligand is cis-presented on the cell that expresses the receptor, the synNotch receptors display blunted activation (FIG. 38C, column "cell" vs "cell+cis", and FIG. 40B-C) a feature known as cis-inhibition in native Notch.

Figure 38B:
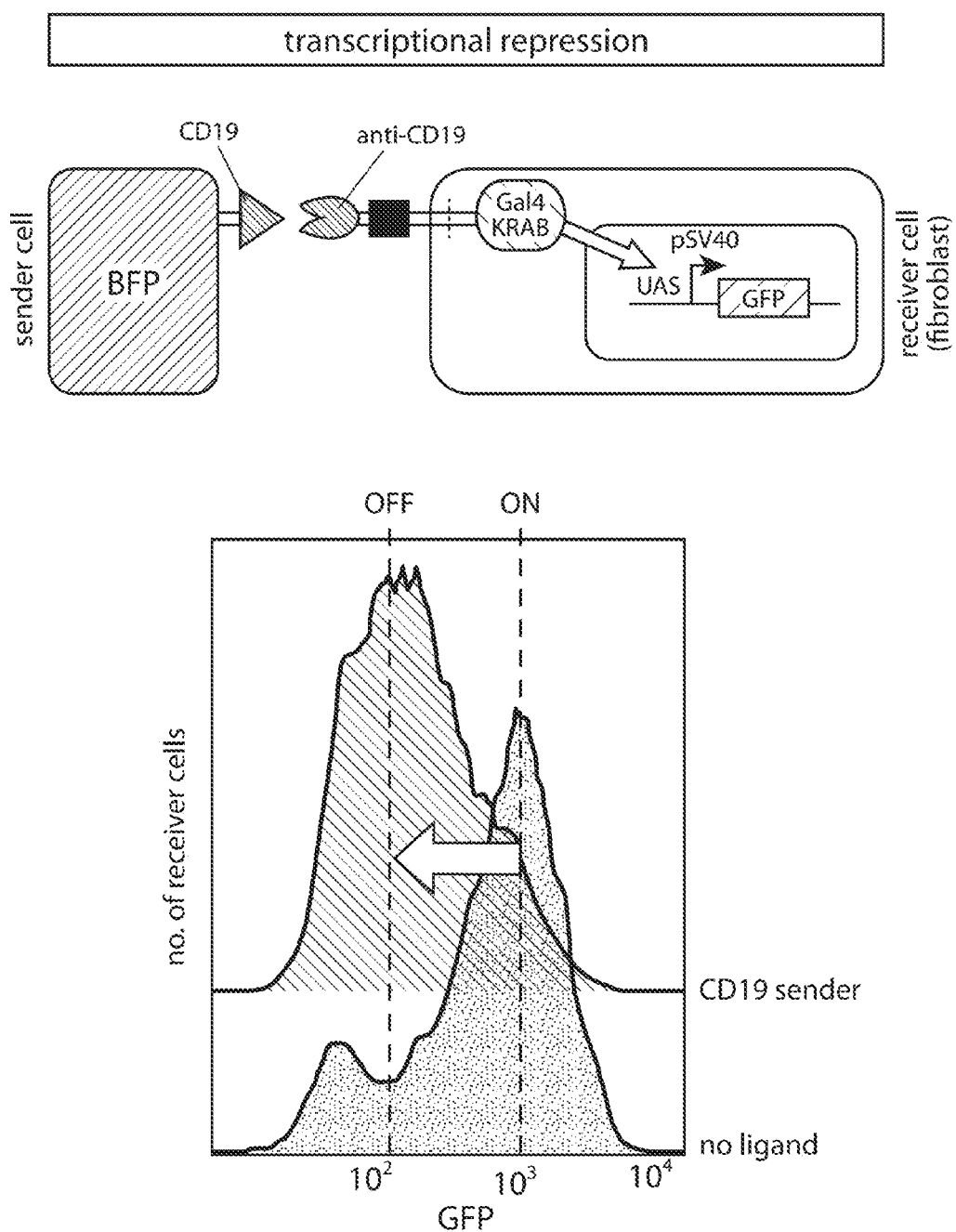

On the intracellular side, it was shown that transcriptional repression as well as activation can be directed. To this end, versions of the receptors that have a transcriptional repressor domain (KRAB) fused to a Gal4DNA-binding domain as intracellular domain were generated. The cells that express this synNotch respond by down-regulating the reporter gene when co-cultivated with sender cells (FIG. 38B).

Other intracellular domains were also inserted into synNotch, including Cre recombinases, and master transcription factors such as MyoD and Snail. While some of these showed regulated activity, in general these activities were quite low, most likely because the synNotch receptor output domain functions stoichiometrically and does not show amplification. Thus this receptor system, may work better for highly amplified outputs.

Synthetic Notch Receptors Work in Diverse Primary Cells: Neurons & Immune Cells.

SynNotch cell lines showed robust activation upon receptor activation. To test if this result is cell-line specific or not, synNotch receiver cell lines were produced by engineering a series of established cell lines: epithelial MDCK cells, L929 and C3H mouse fibroblasts cell lines, HEK293 human epithelial cell lines, Jurkat T cells. All of them invariably showed a robust induction of reporter gene activation upon synNotch receptor activation (FIG. 41B). Importantly, primary cells can also be engineered with synNotch receptors, and in this way they become responsive to novel ligand stimulation. In FIG. 41A (and FIG. 42) it is shown that primary hippocampal neurons that express the synNotch and the reporter can be induced to express a GFP reporter cassette by contact with ligand-expressing sender cells.

Synthetic Notch Receptors can Regulate Diverse Cellular Behaviors in a Spatially Controlled Manner.

Figure 43A:
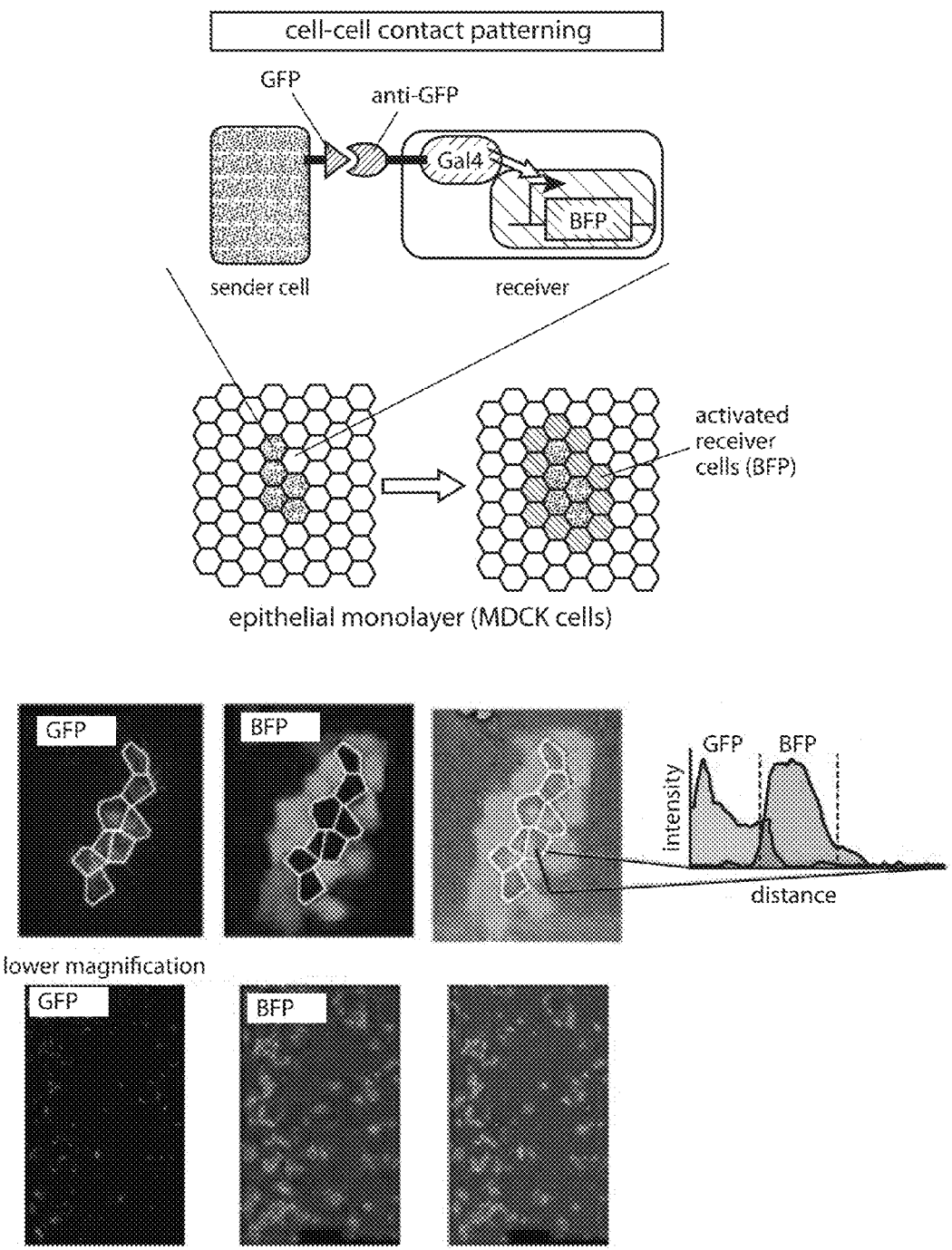

SynNotch receiver cells can detect whether the neighbor cells are expressing the ligand or not. Whether synNotch receiver cells placed in an epithelial cell layer could be spatially induced to express a reporter gene was tested. When ligand-expressing sender cells are sparsely plated in a layer of receiver cells, only the receiver cells that are directly contacting the sender cells activate the synthetic Notch receptor, as visible by the ring of blue cells (activated receivers) around the green sender cells, while the receiver cells further away stay inactive (FIG. 43A).

Whether this synthetic cell-cell signaling could be used to regulate cell fate in a spatially controlled manner was then tested. Specifically, whether syn-Notch receptor could be used to induce expression of a cell fate master regulator such as MyoD, a controller of muscle cell fate, was tested. As shown in FIG. 41B, transdifferentiation of synNotch fibroblasts can be induced only in the vicinity of ligand-expressing cells. In this experiment, CD19-expressing cells are locally plated first, and then anti-CD19-synNotch fibroblasts are overlaid uniformly. Where the synNotch receptor engages with its ligand the receiver fibroblasts upregulate myoD, the prototypical master transcription factor for myogenesis, which leads to transdifferentiation and formation of myotubes only locally (green channel from myoD-GFP in receiver cells spatially overlap with blue channel from BFP in sender cells, FIG. 41B; see FIG. 44A for a time-course).

Figure 43C:
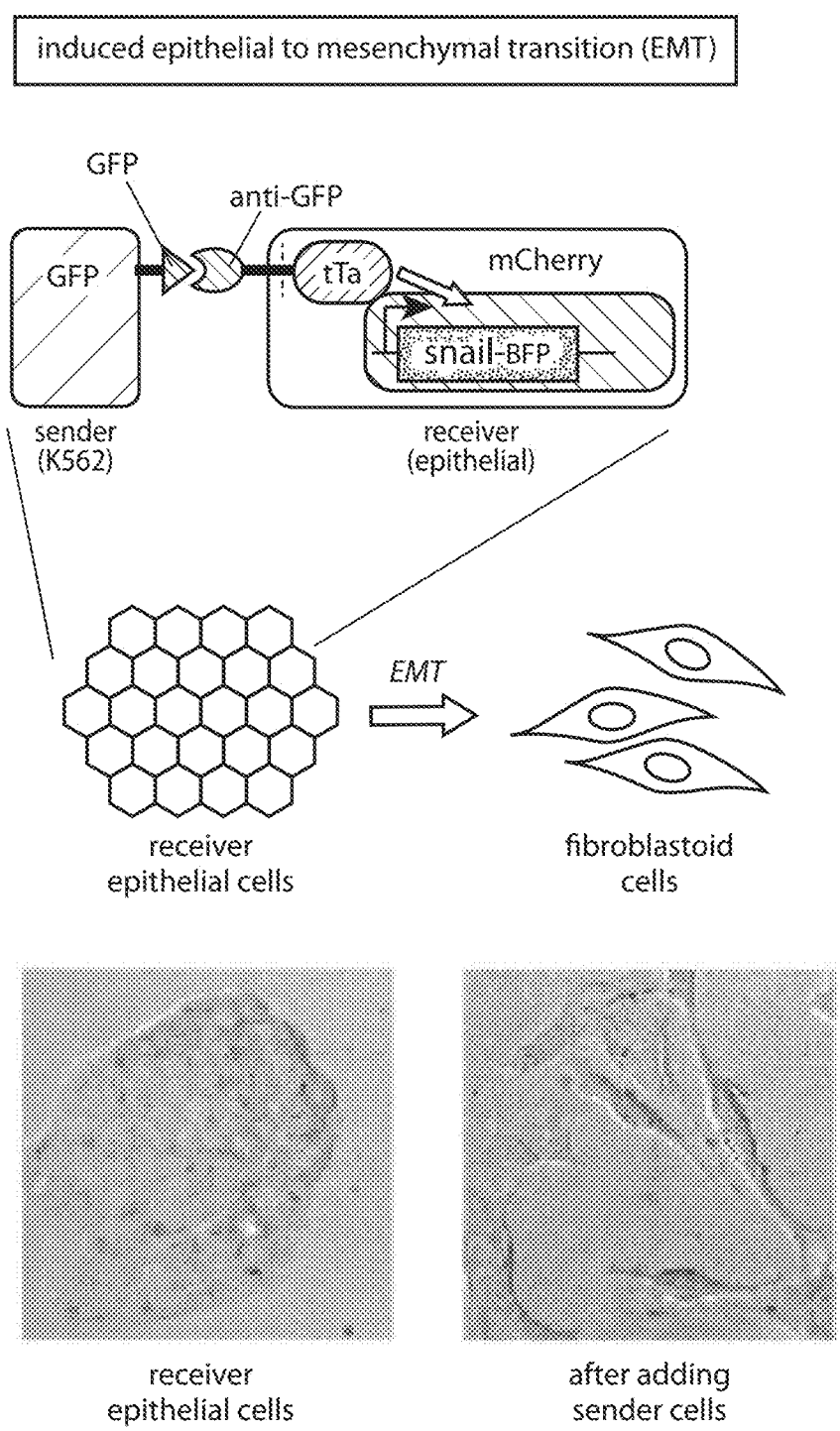

In another example, that synNotch could be used to control epithelial-to-mesenchymal transition was demonstrated. The anti-GFP (or the anti-CD19) was used to control expression of the EMT master regulator gene snail. In these epithelial cells, epithelial to mesenchymal transition was induced by exposing them to ligand-GFP expressing cells, but not non-ligand expressing cells (FIGS. 43C and 44B).

Figure 43D:
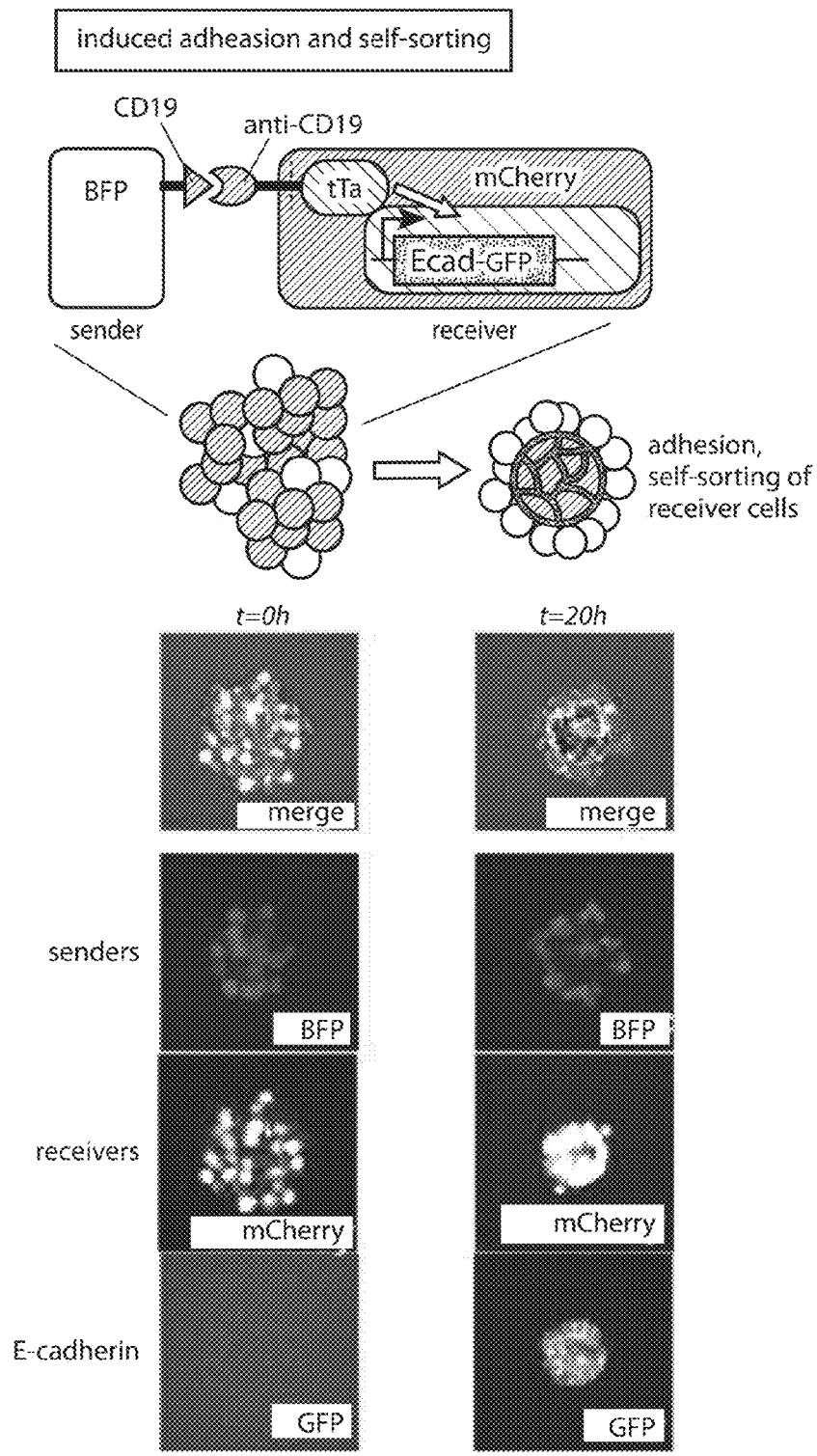
Figure 44A:
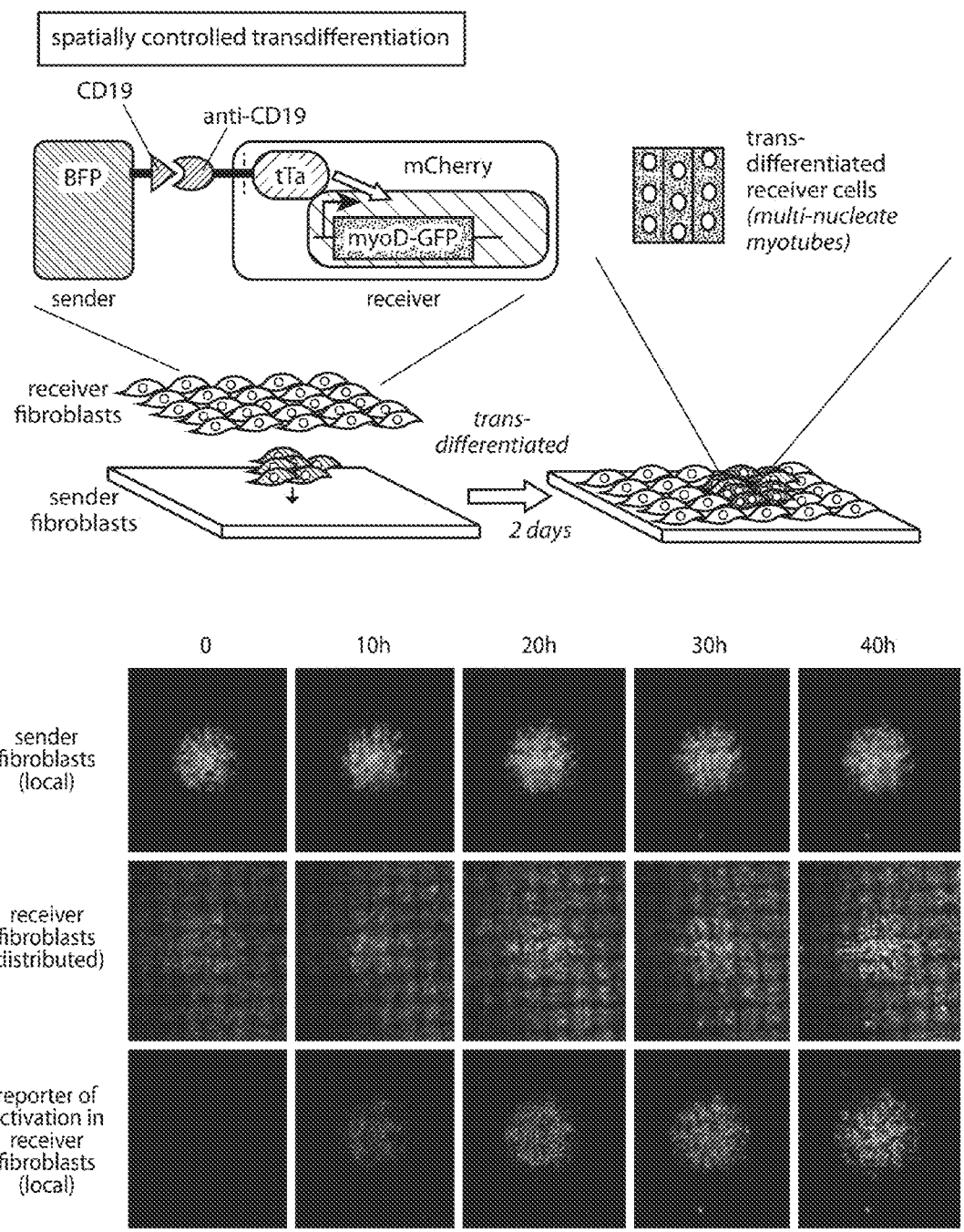

It was also shown that synNotch can be used to control spatial self-organization of multicellular assemblies. For these experiments, engineered fibroblasts were cultured as spheroids in low adhesive plates, a setup where relative cell-cell adhesion strength dictates the geometry. Receiver cells expressing anti-CD19 synNotch induce of E-cadherin upon stimulation by sender cells expressing CD19. At the beginning of the experiment, CD19-sender and anti-CD19-synNotch receiver cells are randomly mixed (FIG. 43D, left). The induction of E-cadherin expression downstream of the synNotch in the receiver cells increases their adhesion potential. The activated receiver cells now adhere strongly with one another and move in the inside of the spheroid, leaving the sender cells on the outer layer (FIG. 43D). As a control, it was shown that this inside-out asymmetry of sender and receiver cells self-organizes when only a fluorescent protein is activated in response to synNotch activation, in place of E-cadherin (FIG. 44C).

Synthetic Notch Receptors are Orthogonal to Each Other and Native Notch.

Whether multiple synNotch receptors could function within the same cell without crosstalk was explored. Orthogonal function would allow the cell to elaborate different outputs according to the presence or absence of multiple inputs. It was hypothesized that synNotch receptors might function orthogonally to one another because of the mechanism of signaling—there are no common intermediates (e.g. an activated kinase) that could yield cross talk, if the intracellular transcriptional regulators in the different receptors are distinct. If there was any cross talk between the synNotch and the endogenous Notch signaling was first tested. To show this, cells were engineered to report on the anti-CD19-synNotch as well as the full-length-Notch with different fluorescent proteins. When the cells were stimulated with only Delta, only the full-length-Notch response was activated; the same applies to the synNotch response to CD19: The two pathways show independent activation (FIG. 45A).

Figure 46A:
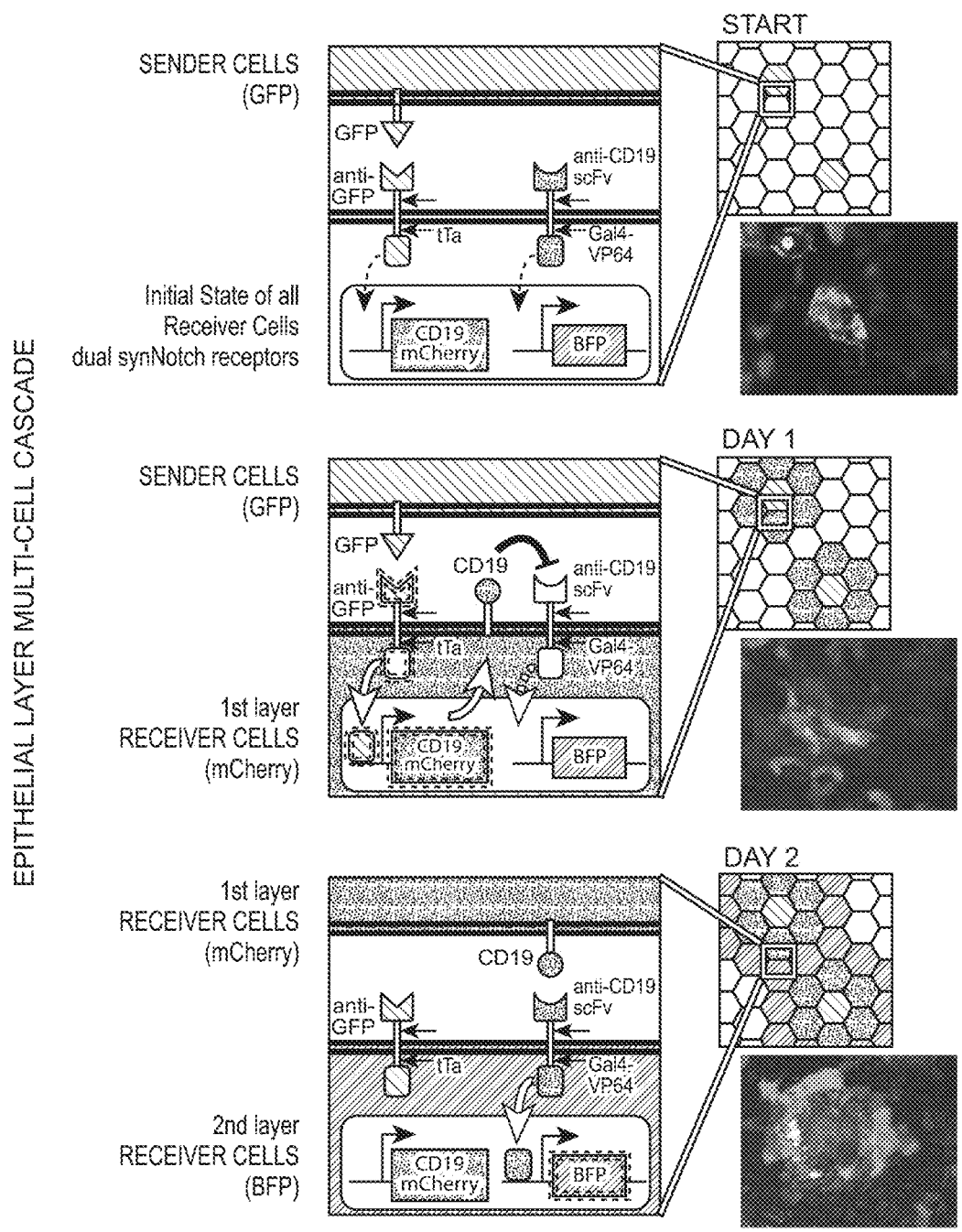
FIGS. 46A-46C demonstrate that multiple synNotch receptors can be used to generate multi-layered self-organizing epithelial patterns.
Figure 46C:
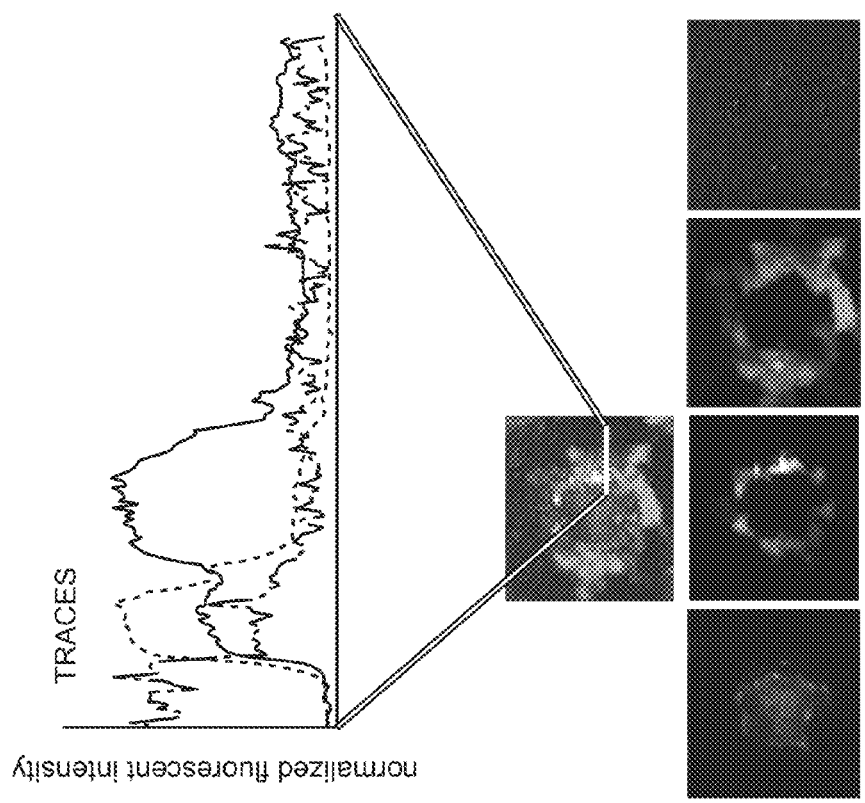
Figure 46B:
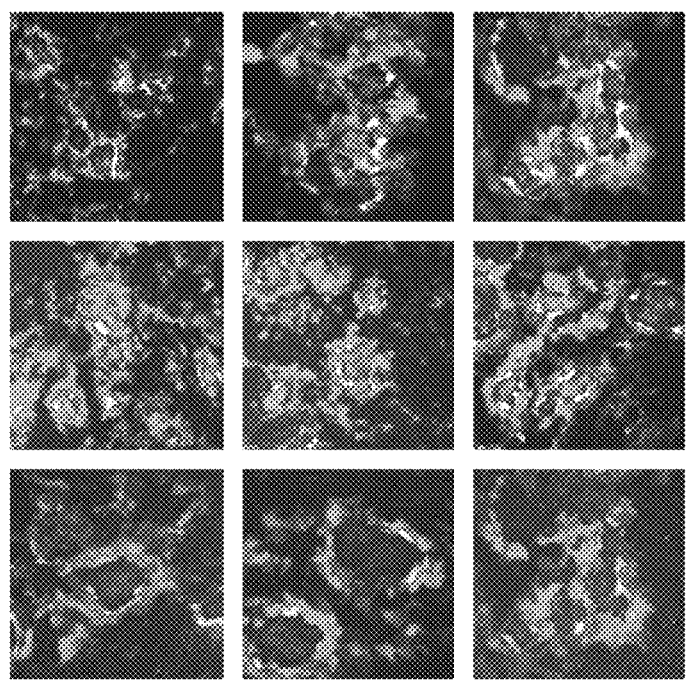

Whether two different synNotch receptors could function independently in the same cell was then tested. In FIG. 45B the results of stimulation with single as well as combined ligands for two independent synNotch receptors, an anti-CD19 receptor and an anti-GFP receptor, were reported. Each is linked to a different intracellular transcription activation domain (Gal4 and tTA respectively), which in turn drives a distinct reporter fluorescent protein. When activated by CD19, only the anti-CD19-synNotch response is activated; conversely, when activated by GFP-expressing sender cells, only the anti-GFP-synNotch response is activated. Importantly, when the cells are stimulated by both CD19 and GFP the two responses are activated together (FIG. 46B). Thus multiple synNotch receptors can work in the same cell as insulated signaling transduction pathways.

Multiple synNotch Receptors can be Used to Engineer Cells that Combinatorially Integrate Multiple Inputs.

Multiple synNotch receptors can be used in the same cell to generate diverse responses. The engineering of cells that integrate combinatorial environmental cues and respond only when certain criteria are met were designed. In particular, the generation of cells that would respond only in the presence of two different antigens on their environment, but would not respond to each one alone, were concentrated on. To achieve this, double synNotch expressing cells with anti-CD19 and anti-GFP extracellular domains: the activation of each synNotch activates a half of a split-Gal4 protein, were engineered. It this way, when the two inputs are presented to the receiver cell alone no activation is visible (FIG. 45C, columns 1-3). Only when the two receptors are activated is the split molecule reconstituted and the response in receiver cells induced (FIG. 45C, last column).

Engineering Cascades of Cell-Cell Signaling with Multiple synNotch Receptors.

With multiple synNotch receptors for cell-cell communication, multicellular signaling systems of cell-cell communication were designed. In particular, the induction of self-organized multi-layer spatial patterning in epithelial cell layers was focused on. For this, the receiver cells have two synNotches, one of which induces the ligand for the other. In this particular example, the anti-GFP-synNotch induces CD19 ligand expression (and the reporter protein mCherry); and the anti-CD19-synNotch induces the reporter protein tagBFP. Then, to start the induction of the cascade of layers, GFP sender cells are seeded sparsely in a monolayer of the double synNotch receiver cells. This circuit enabled the formation of two concentric rings of activation around the sender cell islands: the first neighbors become red after the activation of the anti-GFP-synNotch, and they become CD19 sender (FIG. 46A, Day1). The cells one diameter further from the sender cells can now respond to the CD19 ligand expressed by the first neighbors, generating the double-ring pattern of FIG. 46A, Day2. In this way, two different cell types are produced in a spatially controlled manner from a uniform population of receiver cells (FIG. 46C). Thus multiple syn-Notch receptors can be used to engineer more complex multistep patterning responses, akin to what is observed in natural developmental processes (FIG. 46B).

FIG. 37. Modular Configuration of synNotch Receptors (FIG. 37A) Conceptual design of synNotch receptor systems, as a successive engineering starting from wild-type Notch, to Notch reporters, to synNotch receptors. The latter exploit the flexibility of intracellular orthogonal transcription factor of the notch reporter, and build a platform that responds to novel inputs by replacing the extracellular domain.

(FIG. 37B) Modularity of the platform: extracellular, transmembrane and intracellular domains abstracted from the Notch domain structure can be swapped with diverse domains on the outside (antibody based, or peptide tags are shown) and diverse effector in the inside (transcriptional activator with different DNA-binding domains are shown, as well as a transcriptional repressor).

FIG. 39 Provides Data Related to FIG. 37.

(FIG. 39A) Series of synNotch receiver cells with different extracellular and intracellular domains show activation upon stimulation with cognate ligand. Cells are mouse fibroblasts line L929, and are stimulated either by plate-bound stimulus or with sender cells expressing the ligand, as indicated in figure.

(FIG. 39B) Time course of activation of receiver cells upon sender cells addition (left); after full activation is reached, removal of sender cells induces inactivation of receiver cells (right).

(FIG. 39C) Dose response of activation of receiver cells with different amount of plate-bound ligand. Myc-tag synNotch (left) and anti-GFP synNotch (right) receiver cells are exposed to increasing amount of ligand; the reporter integrated intensity at 24h is shown in the graphs.

(FIG. 39D) SynNotch expression levels linearly influence the intensity of reporter activation. In the graph is shown reporter intensity against receptor expression levels for n=24 clonal population of fibroblasts expressing the synNotch with myc-tag extracellular domain, inducing GFP as reporter. The blue dots are data from unstimulated cells, the green dots are data recorded after stimulation. A positive correlation between receptor expression and GFP intensity is appreciable.

FIG. 38. SynNotch Receptors can be Used to Program Contact-Dependent Transcriptional Regulation.

(FIG. 38A). Synthetic notch receptors can be used to detect endogenous disease antigens and increase or decrease transcription of a reporter gene.

(FIG. 38A) Mouse fibroblasts (L929 line) with anti-CD19/tTA synNotch are cultivated with sender cells expressing Delta, or CD19, or CD19 in the presence of the gamma-secretase inhibitor DAPT. FACS plots of the resulting GFP intensity in receiver cells are shown.

(FIG. 38B) Mouse fibroblasts (L929 line) with anti-CD19 synNotch with a transcriptional repressor intracellular domain are co-cultivated with or without sender cells. The receiver cells express constitutively GFP downstream of a SV40/UAS combined promoter. FACS plot of receiver cells GFP intensity is shown, both in presence of sender cells with or without CD19 on the membrane.

(FIG. 38C) Mouse fibroblasts (L929) lines expressing synNotch stimulation with ligands in different formats. Left: anti-GFP/tTA synNotch receiver cells are simulated with GFP either soluble, or sender-cell presented, or cis-presented on the receiver cell. The bar graph shows the reporter activation in the presence of the various ligand presentation choices: activation happens when the ligand is present on an opposing surface only. Right: myc-tagged anti-CD19/tTA synNotch receiver cells are stimulated with ligands in different formats, either anti-myc soluble antibody, or CD19 from sender cells or CD19 in the same receiver cell (cis). The bar graph shows the activation of the reporter: activation is induced when the ligand is presented on an opposing surface only.

FIG. 40. Related to FIG. 38.

(FIG. 40A) Addition of an EGF-repeat on the extracellular domain reduces basal activation in the anti-mesothelin synNotch. Anti-mesothelin synNotch receptors with or without an EGF repeat before the anti-mesothelin ScFv are introduced in mouse L929 fibroblasts. The activation of these receptors activates a GFP reporter. Data shown are FACS plots in two scenarios: up, without the EGF repeat, the induction of the reporter is constitutive even in the absence of the ligand; bottom, with the EGF repeats, the basal reporter activation is abolished (OFF line), and the induction brings the GFP intensity to the ON state.

(FIG. 40B) Pulsed activation. To stimulate anti-GFP synNotch receiver cells for a short amount of time, receiver cells are seeded on the plated for 24 h and then incubated with suspension sender cells (K562s expressing transmembrane GFP) for 1 h or 4 h; after that, suspension sender cells washed away, and at t=24h from the first addition of sender cells the fluorescence in receiver cells is measured by FACS. Bar graphs are integrated fluorescence response of at least 10,000 cells for each condition. Data are average and standard error. Data are for anti-GFP LaG17 and LaG16/2 extracellular domains.

(FIG. 40C) FACS plots for the cis-inhibition results of main FIG. 38C. Plots are number of cells against reporter fluorescence of at least 10,000 cells for each condition. Sender cells are engineered K562s and receiver cells are engineered L929 mouse fibroblasts. On the left, data for the anti-GFP synNotch are shown; on the right, data for the anti-CD19 synNotch.

FIG. 41. SynNotch Receptors Function in Diverse Cell Types, Including Neurons and Lymphocytes.

(FIG. 41A) Hippocampal neurons. Primary hippocampal neurons are dissociated from E18 rat embryos and are nucleofected to express an anti-CD19 synNotch and a coupled GFP reporter. Neurons are plated on glass-bottom 35 mm culture dish coated with Poly-D-Lysine and Laminin 2 hours after neuron plating, sender cells (K562s) are added to the culture to form co-culture system. Images are taken from live cells at day 4 after plating. On the right, representative images for neurons that are co-cultured with plain K562 cells (upper panel) or with CD19+ K562 sender cells (Bottom panel) are shown. Neurons that co-cultured with ligand presenting sender cells have significantly higher GFP expression than with control cells.

(FIG. 41B) T cell line. Jurkat T cell line is engineered to stably express an anti-CD19/tTA synNotch receptor, that drives GFP as reporter. Data on the right show fluorescence of the Jurkat cells upon stimulation with CD19+ or CD19− sender cells (K562s) at t=24 h. T cells are activated only when they see the synNotch cognate ligand.

FIG. 42. Related to FIG. 41.

(FIG. 42A) Demonstration of the experiment and constructs that are expressed in neurons. Primary hippocampal neurons are disassociated from E18 rat embryos and are nucleofected with constructs that express the cNotch receptor as well as the TetO-GFP reporter. Neurons are plated on glass-bottom 35 mm culture dish coated with Poly-D-Lysine and Laminin 2 hours after neuron plating, K562 sender cells are added to the culture to form co-culture system. Images are taken from live cells at day 4 after plating.

(FIG. 42B) Distribution of the GFP fluorescent intensity in 100 neurons for each treatment. GFP intensity is calculated from the fluorescence confocal images.

(FIG. 42C) Quantification of the average GFP fluorescent intensity from about 100 neurons for each treatment.

FIG. 43. SynNotch Receptors Yield Spatial Control of Diverse Cellular Behaviors (FIG. 43A) Boundary detection in epithelial monolayer. Epithelial cells (MDCKs) are engineered as follows: sender cells express an extracellular GFP linked to a transmembrane domain; receiver cells express the anti-GFP synNotch with LaG17 anti-GFP nanobody as extracellular domain, and Gal4-VP64 as intracellular domain, alongside a UAS-→BFP reporter construct. Sender and receiver in a 1:50 ratio are mixed together and confocal images are taken at 48 h after plating of confluent monolayer. Representative pictures of high magnification and low magnification are shown, alongside with a representative line of intensity of fluorescence over distance. Only receiver cells that are in contact with the green sender cells turn on the blue reporter, forming a ring around the sender cells.

(FIG. 43B) synNotch activation of a myogenesis master regulator (myoD) in fibroblasts induce transdifferentiation in a spatially controlled manner C3H mouse fibroblasts are engineered as follows: sender cells express extracellular CD19 linked to a transmembrane domain, plus a tagBFP marker; receiver cells express the anti-CD19 synNotch with tTA intracellular domain, alongside a TRE→myoD reporter construct and a constitutive mCherry marker. Sender fibroblasts are plated first in a limited region of the plate; after 1 h, the sender cells are attached to the plate, and the receiver cells are plated to cover all the glass plate. Images shown are at 48 h after co-culture (see FIG. 44 for a time course). GFP channel shows the induction of myoD-GFP in a region that overlaps with the blue channel, marking the sender cells. An higher magnification of the field for the green channel is shown on the right.

(FIG. 43C) synNotch can induce epithelial to mesenchymal transition in cultured epithelial cells. Epithelial cells (MDCKs) are engineered as follows: receiver cells express the anti-GFP synNotch with LaG17 anti-GFP nanobody as extracellular domain, and tTA as intracellular domain, alongside a TRE→Snail-ires-BFP effector construct. Sender cells are GFP-expressing K562s. Representative bright field microscope images of epithelial cells before and after the addition of sender cells are shown. See FIG. 44 for quantification.

(FIG. 43D) synNotch induction of adhesion in fibroblasts can govern symmetry-breaking rearrangements in fibroblasts spheroid cultures. L929 mouse fibroblasts are engineered as follows: sender cells express extracellular CD19 linked to a transmembrane domain, plus a tagBFP marker; receiver cells express the anti-CD19 synNotch with tTA intracellular domain, alongside a TRE→E-cadherin-GFP effector construct, and a constitutive red marker (mCherry). Fluorescence signal as collected with microscope is shown at t=0 (left) and at t=20 h (right) for a representative spheroid. At t=0 cells are mixed; at t=20 h receiver cells induce E-cadherin (green channel) and sort in the inner layer of the spheroid (red), whereas the sender cells (blue) are on the outside.

Figure 44A:
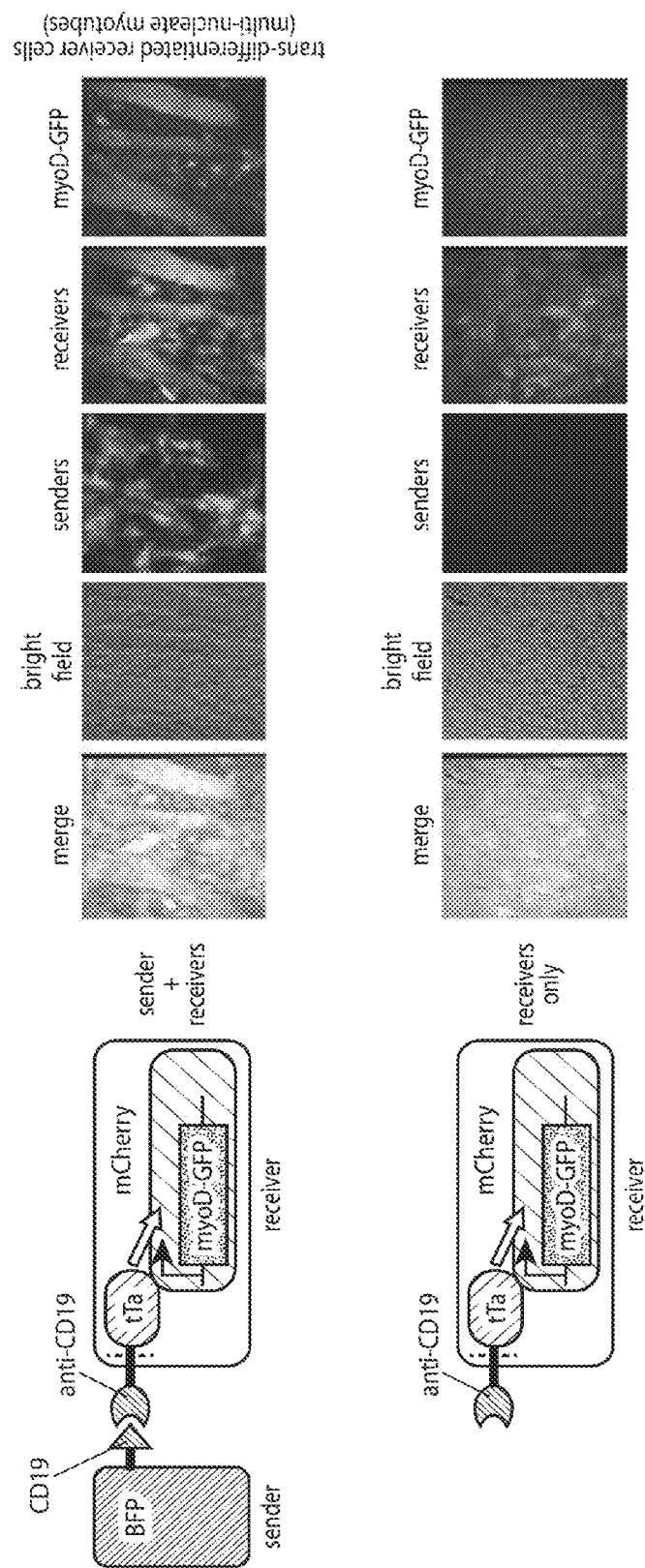
Figure 44C:
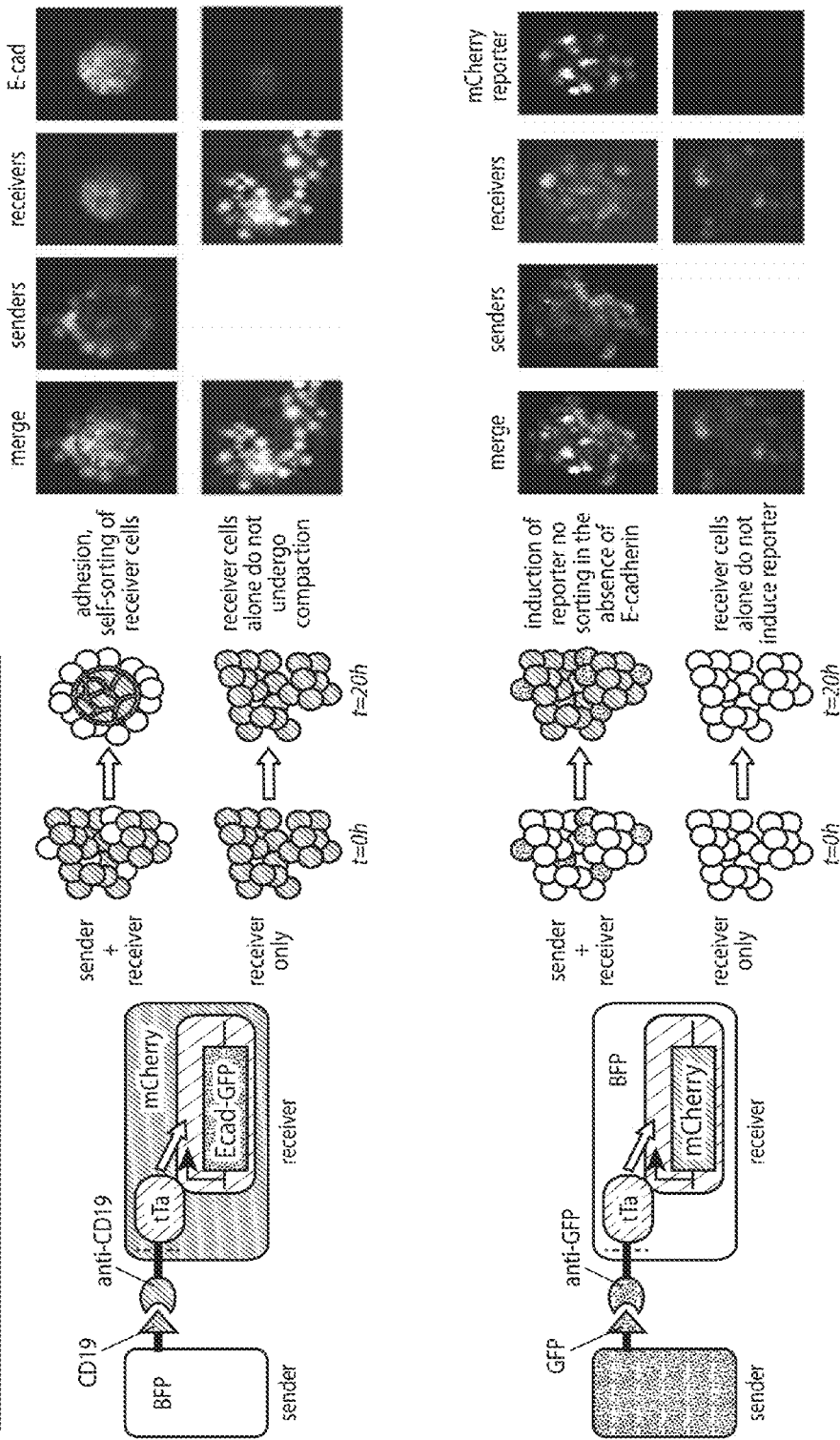

FIG. 44. Related to FIG. 43

(FIG. 44A; Relative to FIG. 43B) C3H mouse fibroblasts are engineered as follows: sender cells express extracellular CD19 linked to a transmembrane domain, plus a tagBFP marker; receiver cells express the anti-CD19 synNotch with tTA intracellular domain, alongside a TRE→myoD effector construct and a constitutive mCherry marker. Sender fibroblasts are plated first in a limited region of the plate; after 1 h, the sender cells are attached to the plate, and the receiver cells are plated to cover all the glass plate. Images are taken every 10 h on the right.

Below, a representative field of an experiment of co-culture of sender and receiver cells (up) or receiver cells alone (bottom) is shown.

(FIG. 44B; Relative to FIG. 43C) Epithelial cells (MDCKs) are engineered as follows: receiver cells express the anti-GFP synNotch with LaG17 anti-GFP nanobody as extracellular domain, and tTA as intracellular domain, alongside a TRE→Snail-ires-BFP effector construct. Sender cells are GFP-expressing K562s. FACS plots of receiver cells BFP signal is shown in presence of no sender cells, of sender cells expressing an unrelated ligand, and of sender cells expressing the cognate ligand GFP. Quantification of the fluorescence is provided on the bar graph.

On the far right, the bar graph reports the E-cadherin expression levels in the receiver cells or of parental cells in the various conditions. E-cadherin levels drops only in the presence of the cognate antigen GFP-expressing sender cells.

(FIG. 44C; Relative to FIG. 43D)

Upper panel: L929 mouse fibroblasts are engineered as follows: sender cells express extracellular CD19 linked to a transmembrane domain, plus a tagBFP marker; receiver cells express the anti-CD19 synNotch with tTA intracellular domain, alongside a TRE→E-cadherin-GFP effector construct, and a constitutive red marker (mCherry). Fluorescence signal as collected with microscope is shown at t=20 h for a representative spheroid with sender and receiver cells, and for one with receiver cells only as indicated. The green fluorescence is induced in the receiver cells only in the presence of the sender cells (E-cad channel, far right).

Lower panel: L929 mouse fibroblasts are engineered as follows: sender cells express extracellular GFP linked to a transmembrane domain; receiver cells express the anti-GFP synNotch with tTA intracellular domain, alongside a TRE→mCherry reporter construct, and a constitutive blue marker (tagBFP). Fluorescence signal as collected with confocal microscope is shown at t=0 t=20 h for a representative spheroid with sender+receiver cells, and for one with only receiver cells. The red fluorescence is induced in the receiver cells only in the presence of the sender cells (mCherry reporter channel, far right). No rearrangements of sender and receiver cells are appreciable.

FIG. 45. SynNotch Receptors are Orthogonal to One Another and can be Used for Combinatorial Regulation (FIG. 45A) synNotch and wild-type Notch activate orthogonal signaling pathways. L929 mouse fibroblasts receivers are engineered to express (i) the wild-type Notch receptor with a tTA intracellular domain and a TRE→GFP reporter, and (ii) a synNotch receptor with anti-CD19 extracellular domain and Gal4-VP64 intracellular domain, and a UAS→tagBFP reporter. The graph on the right reports the receiver cell fluorescence signal for the BFP and the GFP reporters in different conditions: black dots are untreated cells, blue dots receiver cells stimulated with CD19 expressing senders, orange dots are receiver cells stimulated with delta senders, and red dots are receiver cells stimulated with sender cells expressing both CD19 and delta. Sender cells are mouse L929 fibroblasts.

(FIG. 45B) multiple synNotches are orthogonal one another. L929 mouse fibroblasts receivers are engineered to express (i) the anti-CD19 synNotch receptor with a tTA intracellular domain and a TRE→BFP reporter; and also (ii) the synNotch receptor with anti-CD19 extracellular domain and Gal4-VP64 intracellular domain, and a UAS→mCherry reporter. The graph on the right reports the receiver cell fluorescence signal for the BFP and the GFP reporters in different conditions: black dots are untreated cells, red dots are receiver cells stimulated with CD19 expressing senders, green dots are receiver cells stimulated with GFP senders, and blue dots are receiver cells stimulated with sender cells expressing both GFP and CD19. Sender cells are K562s.

(FIG. 45C) Cells engineered with two synNotches can respond only when both the inputs are present. L929 mouse fibroblasts receivers are engineered to express (i) the anti-CD19 synNotch receptor with a tTA intracellular domain and a TRE promoter that drives the expression of the DNA-binding domain (DBD) of Gal4 fused to a leucine zipper domain, and (ii) the synNotch receptor with anti-GFP extracellular domain and the VP64 transcriptional activation domain fused to a complementary leucine zipper as intracellular domain, and (iii) a Gal4-responsive promoter driving a red fluorescent protein (mCherry). The graph on the right shows the normalized mCherry fluorescence collected from receiver cells in co-culture with different sender cells (K562s), that express either the two ligands alone (GFP or CD19), or both ligands together. Activation occurs only in the presence of both the inputs.

FIG. 46. Multiple synNotch Receptors can be Used to Generate Multi-Layered Self-Organizing Epithelial Patterns.

Epithelial cells (MDCKs) are engineered as follows: sender cells express extracellular GFP linked to a transmembrane domain; receiver cells express (i) the anti-GFP synNotch with tTA intracellular domain, alongside a TRE→CD19-mCherry effector cassette; (ii) the anti-CD19 receiver with Gal4-VP64 intracellular domain, and a UAS→tagBFP reporter.

(FIG. 46A) Representative images are shown for the epithelial layer of sender cells and receiver cells co-cultivated at a 1:50 ratio for 10 h (START) 34 h (DAY 1) and 58 h (DAY2).

(FIG. 46B) Multiple images of different fields of view of the co-culture at day 2.

(FIG. 46C) Representative quantification of the fluorescence signal as calculated from the fluorescence images for a pattern around sender cells at day 2.

Figure 47A:
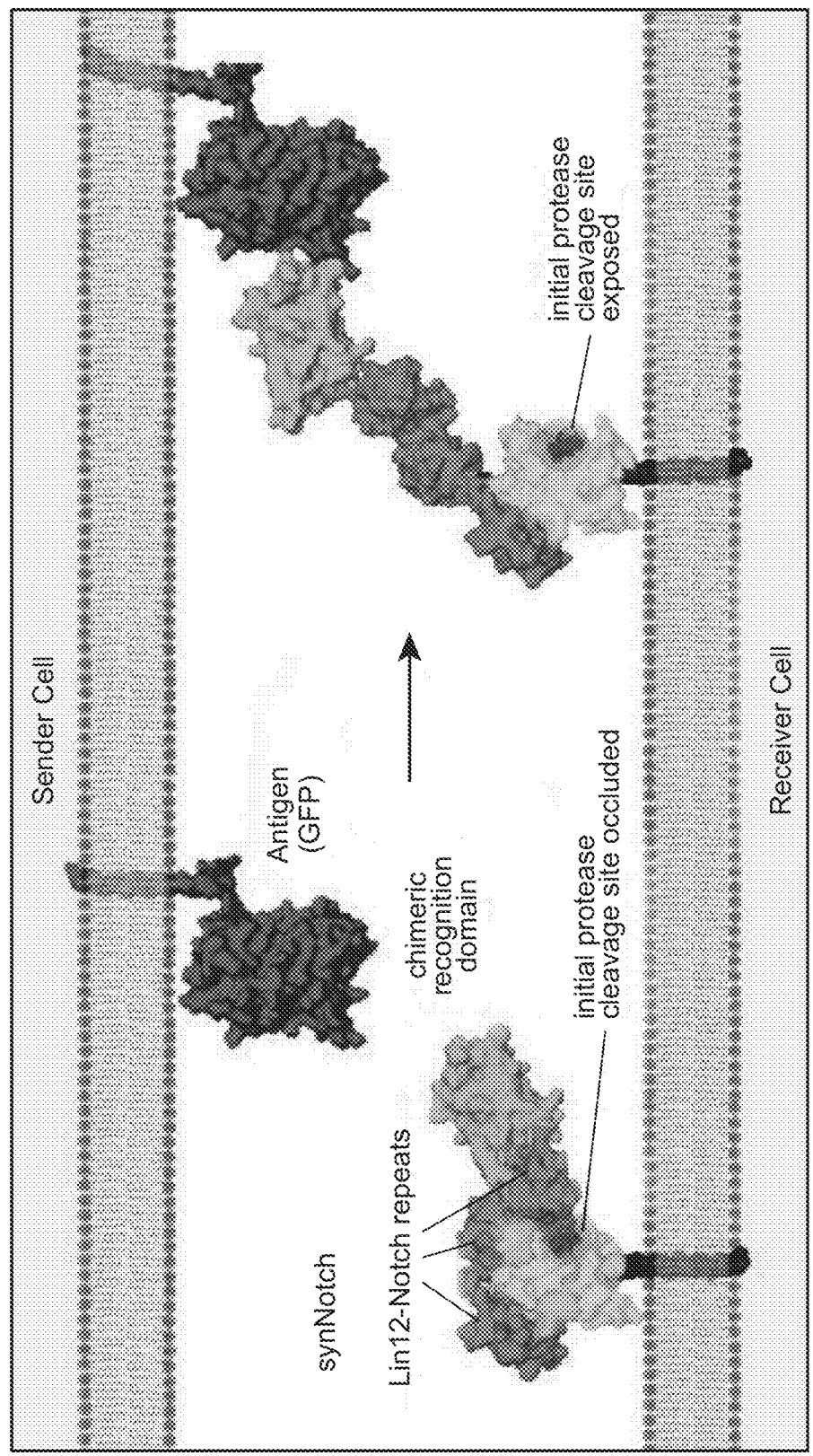
FIGS. 47A-47C show that the modularity of synNotch receptors expands sensing/response engineering of mammalian cells.
Figure 47B:
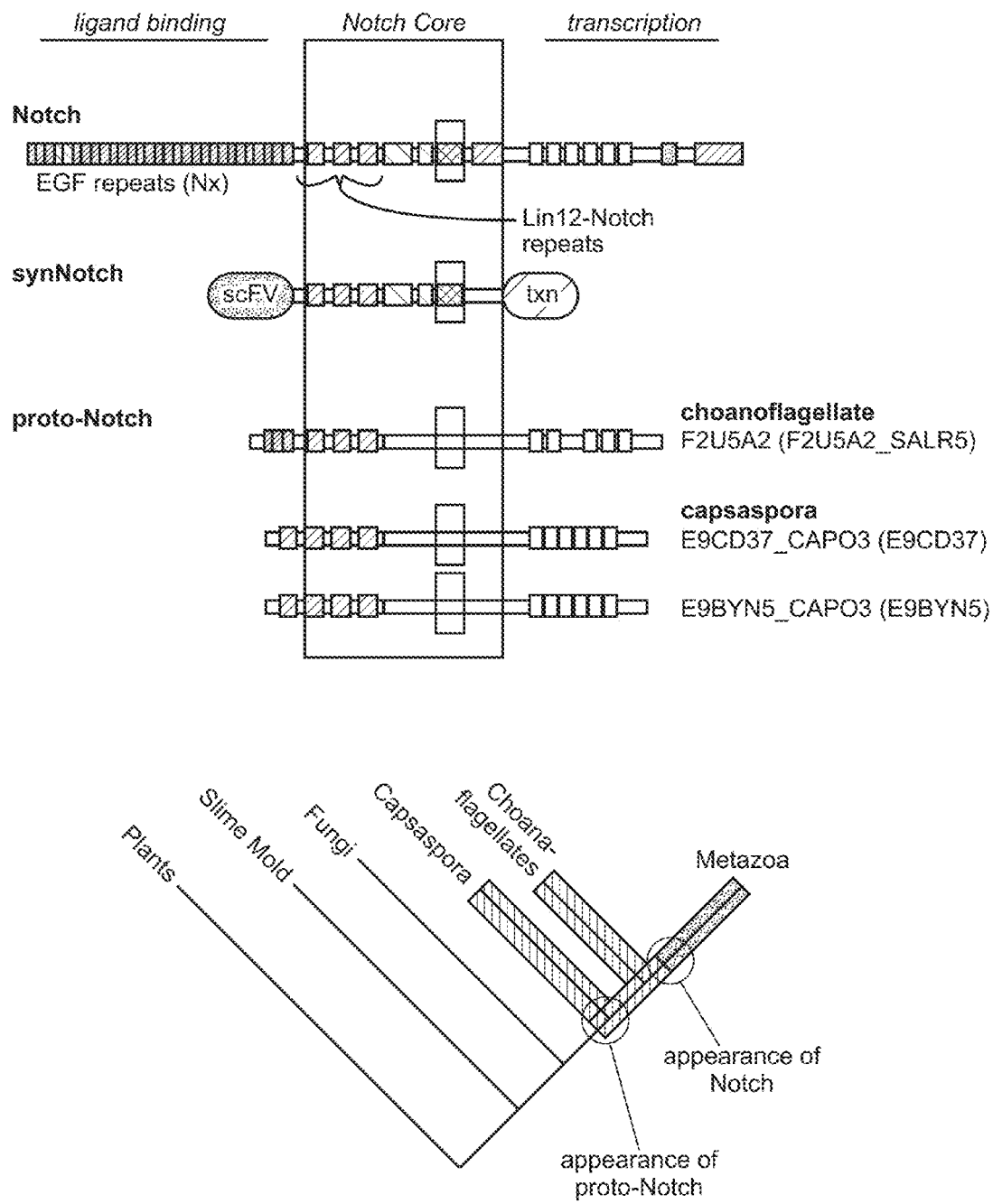
Figure 47C:
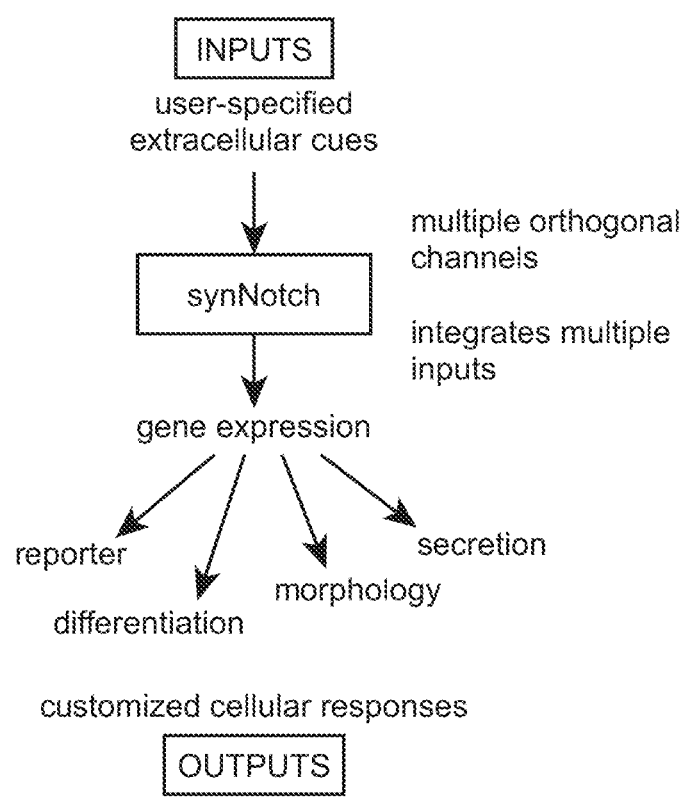

FIG. 47. Modularity of synNotch Receptors Expands Sensing/Response Engineering of Mammalian Cells.

(FIG. 47A) Putative structural mechanism of activation of the synNotch receptors. The LNR domains mask the protease cleavage site in the unbound conformation (left). When the ligand engages the receptor, the site is exposed and this event start the transduction (right).

(FIG. 47B) Alignment of LNR-containing molecules from early metazoan.

(FIG. 47C) The modularity of the synNotch receptor platform allow the user to specify the extracellular cues the cells now respond to, as well as the cellular responses that are induced downstream of receptor activation.

Example 4: Engineering T Cells with Customized Therapeutic Response Programs Using Synthetic Notch Receptors Material and Methods The following materials and methods apply to the results described in Example 4 unless otherwise indicated.

synNotch Receptor and Response Element Construct Design synNotch receptors were built by fusing the CD19 scFv, LaG17 (lower affinity), or LaG16_2 (high affinity) GFP nanobody to the mouse Notch1 (NM_008714) minimal regulatory region (Ile1427 to Arg1752) and Gal4VP64. All synNotch receptors contain an n-terminal CD8a signal peptide (MALPVTALLLPLALLLHAARP (SEQ ID NO:129)) for membrane targeting and a myc-tag (EQKLISEEDL (SEQ ID NO:75)) for easy determination of surface expression with α-myc A647 (cell-signaling #2233). The receptors were cloned into a modified pHR'SIN:CSW vector containing a PGK promoter for all primary T cell experiments. The pHR'SIN:CSW vector was also modified to make the response element plasmids. Five copies of the Gal4 DNA binding domain target sequence (GGAGCACTGTCCTCGAACG (SEQ ID NO:130)) were cloned 5' to a minimal CMV promoter. The human IL-2, IL-10, Tbet, or TRAIL codon optimized mRNA sequence was cloned into a MCS downstream of the Gal4 inducible promoter and 5' of an IRES mCherry reporter. All constructs were cloned via In-Fusion cloning (Clontech #ST0345)).

Primary Human T Cell Isolation and Culture

Primary CD4+ and CD8+ T cells were isolated from anonymous donor blood after apheresis by negative selection (STEMCELL Technologies #15062 & 15063). Blood was obtained from Blood Centers of the Pacific (San Francisco, Calif.) as approved by the University Institutional Review Board. T cells were cryopreserved in RPMI-1640 (UCSF cell culture core) with 20% human AB serum (Valley Biomedical Inc., #HP1022) and 10% DMSO. After thawing, T cells were cultured in human T cell medium consisting of X-VIVO 15 (Lonza #04-418Q), 5% Human AB serum and 10 mM neutralized N-acetyl L-Cysteine (Sigma-Aldrich #A9165) supplemented with 30 units/mL IL-2 (NCI BRB Preclinical Repository) for all experiments of Example 4.

Lentiviral Transduction of Human T Cells

Pantropic VSV-G pseudotyped lentivirus was produced via transfection of Lenti-X 293T cells (Clonetech #11131D) with a pHR'SIN:CSW transgene expression vector and the viral packaging plasmids pCMVdR8.91 and pMD2.G using Fugene HD (Promega #E2312). Primary T cells were thawed the same day, and after 24 hours in culture, were stimulated with Dynabeads Human T-Activator CD3/CD28 (Life Technologies #11131D) at a 1:3 cell:bead ratio. At 48 hours, viral supernatant was harvested and the primary T cells were exposed to the virus for 24 hours. At day 4 post T cell stimulation, Dynabeads were removed and the T cells expanded until day 9 when they were rested and could be used in assays. T cells were sorted for assays with a FACs ARIA II.

Cancer Cell Lines

The cancer cell lines used were K562 myelogenous leukemia cells (ATCC #CCL-243), Daudi B cell lymphoblasts (ATCC #CCL-213), and HCT115 colon cancer cells (ATCC #CCL-247). K562s were lentivirally transduced to stably express human CD19 at equivalent levels as Daudi tumors. CD19 levels were determined by staining the cells with α-CD19 APC (Biolegend #302212). K562s were also transduced to stably express surface GFP (GFP fused to the PDGF transmembrane domain). All cell lines were sorted for expression of the transgenes.

In Vitro Stimulation of synNotch T Cells

For all in vitro synNotch T cell stimulations, $2 \times 10^5$ T cells were co-cultured with sender cells at a 1:1 ratio. After mixing the T cells and sender cells in round bottom 96-well tissue culture plates, the cells were centrifuged for 1 min at 400×g to force interaction of the cells and the cultures were analyzed at 24 hours for reporter expression or expression of custom gene induction via flow cytometry with a BD LSR II. All flow cytometry analysis was performed in FlowJo software (TreeStar).

Luminex MAGPIX Cytokine Quantification

Primary CD4+ T cells expressing the α-CD19 synNotch Gal4VP64 receptor and 5× Gal4 response elements controlling either human IL-2 or IL-10 expression were stimulated as described above with K562 myelogenous leukemia cells (CD19– or CD19+). As references, CD4+ T cells expressing the α-CD19 4-1BBζ CAR were stimulated along with untransduced T cells stimulated with α-CD3/CD28 Dynabeads at a 1:3 ratio. The supernatant was collected at 24 hours and analyzed with a Luminex MAGPIX (Luminex Corp.) Human Cytokine Magentic 25-plex Panel (Invitrogen ref#LHC0009M) according to the manufacturer's protocol. All cytokine levels were calculated based on standard curves with xPONENT software (Luminex Corp.).

IL-2 Intracellular Cytokine Staining and CD69 Staining synNotch T cells controlling IL-2 production were assayed to determine if they basally produced IL-2 by intracellular cytokine stain (ICS). The synNotch T cells and untransduced T cell controls were cultured for 6 hours in the presence of GolgiPlug (BD Biosciences #555029). The T cells were then stained with α-IL-2 FITC (BD #340448) with a BD Biosciences ICS kit (#555028). The levels of IL-2 were analyzed via flow cytometry with a BD LSRII.

To assess whether synNotch receptors activated the T cells, the T cells were stained after stimulation for the activation marker CD69. CD69 expression was determined by staining the cells with α-CD69 APC (Biolegend #310910).

synNotch Driven T Cell Differentiation

Primary human CD4+ T cells were stimulated with Dynabeads Human T-Activator CD3/CD28 as described above. To differentiate T cells into the $T_{h1}$ subset during the activation, the cells were cultured as described above but with the addition of 2.5 ng/mL recombinant IL-12 (R&D Systems) and 12.5 µg/mL α-IL-4 clone MP4-25D2 (BD Pharmigen #554481). IL-12 and α-IL-4 were added at least twice weekly. In parallel, primary CD4 T cells were lentivirally transduced to express human Tbet T2A mCherry (TBX21, NCBI #EAW94804.1) and cultured normally in T cell medium supplemented with IL-2. CD4+ T cells expressing the α-CD19 synNotch Gal4VP64 receptor and 5× Gal4 response elements controlling Tbet T2A GFP expression were cultured in the presence of CD19− or CD19+ K562 sender cells 24 hours after viral transduction. The synNotch T cells were cultured in the presence of K562s in T cell medium supplemented with IL-2. All T cells were cultured for 11 to 14 days and then subject to intracellular cytokine staining (ICS) to determine the percentage of $T_{h1}$ T cells.

For ICS, the T cells were first treated with 50 ng/mL Phorbal myristate acetate and 1 µg/mL ionomycin (both from Sigma) for 6 hours in the presence of GolgiPlug. The T cells were then stained with α-Tbet BV421 (Biolegend #644816) and α-IFNγ APC (Biolegend #502512). The levels of Tbet and IFNγ were analyzed via flow cytometry with a BD LSRII.

Sensitivity of Cancer Cell Lines to Recombinant TRAIL and synNotch Driven TRAIL Production in Primary T Cells HCT116 colon cancer cells and K562s were treated with recombinant TRAIL (from 1 to 200 ng/mL, 1:2 dilution series) for 24 hours. The cells were then harvested and stained with the live/dead stain, SYTOX Blue (Thermo Scientific #S34857) and the fraction of dead cells was determined by flow cytometry on a BD LSR II. The level of the death receptor 4 (DR4) expressed by K562s was assessed by staining with α-TRAIL R1 (DR4) APC (Biolegend #307208).

For synNotch driven TRAIL cytotoxicity assays, primary human CD4+ T cells were transduced to express the α-GFP nanobody (LaG17) synNotch Gal4VP64 receptor and 5× Gal4 response elements controlling the expression of LZ-TRAIL or cell surface wild-type TRAIL. The synNotch TRAIL killer cells were co-cultured with surface GFP+ or GFP− K562s for 24 hrs and death was determined by staining with SYTOX Blue. Surface levels of TRAIL was determined by staining T cells with α-TRAIL (CD253) APC (Biolegend #308210). Production and secretion of LZ-TRAIL was determined by TRAIL ELISA (R&D systems #DTRL00).

Xenograft Tumor Model, Cell Isolation, and Flow Cytometry

Animal studies were conducted with the UCSF Preclinical Therapeutics Core under a protocol approved by the UCSF Institutional Animal Care and Use Committee. NOD scid gamma (NSG) (female, 8~12 weeks old, Jackson Laboratory #005557) mice were used for all in vivo mouse experiments. Primary CD4+ and CD8+ T cells expressing the α-CD19 synNotch Gal4VP64 receptor and 5× Gal4 response elements controlling human IL-2 IRES mCherry were sorted and used in the experiments.

The mice were injected on day 0 with $5 \times 10^6$ CD19+ and CD19− K562s subcutaneously on the right flank and left flank of the mice, respectively. The tumors were allowed to establish for 4 days and T cells were injected via the tail vein (i.v.) on day 4 or intratumoral on day 8. The T cells were suspended in PBS for all injections. CD4+ and CD8+ synNotch T cells were injected at a 1:1 ratio. For i.v. injections, $6 \times 10^6$ total T cells were injected, and for intratumoral injections, $5 \times 10^5$ total T cells were injected.

Tumors were harvested at day 10 into RPMI supplemented with 1% FBS (UCSF Cell Culture Core). The tumors were then minced by razor blade and digested for an hour in RPMI with 0.1 mg/mL DNase (Roche #10104159001) and 0.2 mg/mL collagenase P (Roche #11249002001) at 37° C. After incubation, the digested tumors were passed over a 75 µm cell strainer and the tumor cells were collected by centrifugation. The cells were then treated with red blood cell lysis buffer (Biolegend #420301) and washed with PBS. The tumors were then stained with a LIVE/DEAD Green (Thermo Scientific #34969) and α-CD4 A647 (BD 557707) and α-CD8 BV786 (BD #583823) to analyze the tumor infiltrating T cells. Expression of IL-2 IRES mCherry was assessed in the CD4+ and CD8+ T cell populations with a BD LSR II.

Statistical Analysis

Statistical significance was determined by Student's t test (two-tailed) unless otherwise noted. All statistical analysis for Example 4 was performed with Prism 6 (Graphpad) and p values are reported (n.s.=p>0.05, *=p≤0.05, =p≤0.01, *=p≤0.001, ****=p≤0.0001). All error bars represent either S.E.M. or S.D.

Figure 48B:
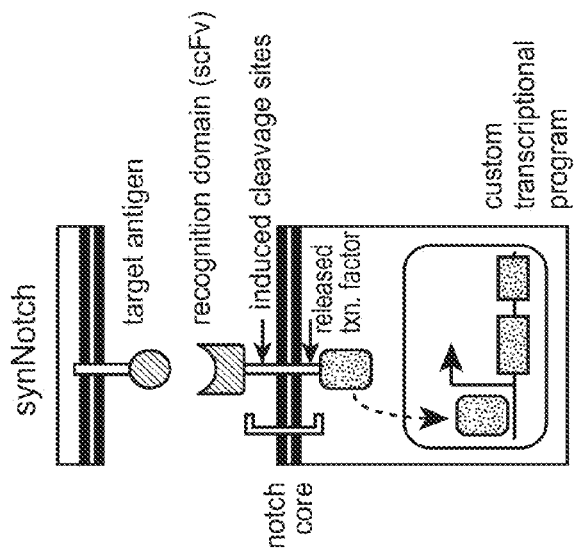
FIGS. 48A-48C demonstrate the potential to engineer customized therapeutic T cell responses using synNotch Receptors.

Results synNotch Receptors can Drive Antigen-Induced Transcription in CD4+ and CD8+ Human Primary T Lymphocytes The Notch receptor has three critical components: 1) the ligand-binding epidermal growth factor (EGF) repeats, 2) the core regulatory region that controls cleavage of the receptor during activation, and 3) the Notch intracellular domain (NICD) that is released and regulates transcription. To build a synNotch receptor platform that allows for fully customizable receptor targeting and transcriptional regulation, the Notch core regulatory region that controls ligand-dependent cleavage and activation was utilized as a minimal scaffold, but then appended with customized input recognition and output transcriptional modules (see Example 3). The Notch core regulatory region includes the Lin12-Notch repeats (LNRs) that control the accessibility of the S2 cleavage site to metalloproteases, the heterodimerization domains (HD), and transmembrane domain (TMD) that contains the γ-secretase cleavage site required for release of the Notch intracellular domain (NICD). The extracellular EGF repeats, normally involved in recognition of the natural ligand delta, were removed and replaced with a single-chain variable fragment (scFv) directed towards the cancer antigen CD19 or nanobodies to orthogonal antigens, such as surface displayed GFP (FIG. 48B-48C). The NICD that is normally required for transcriptional regulation was replaced with the Gal4 DNA binding domain fused to the tetrameric viral transcriptional activator domain, VP64 (FIG. 48B-48C). This general approach can be used to engineer synNotch receptors to any surface antigen of interest and link receptor activity to a customized cellular output controlled by orthogonal transcription factors and their associated response elements (see Example 3). A range of other extracellular and intracellular domains were also shown to function with synNotch.

Figure 49A:
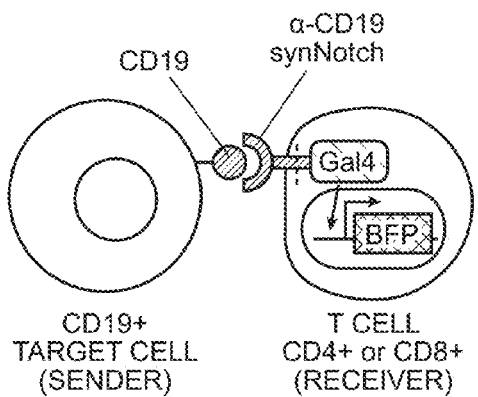
FIGS. 49A-49F show that synNotch receptors can drive antigen-induced transcription in CD4+ and CD8+ human primary T lymphocytes.
Figure 49B:
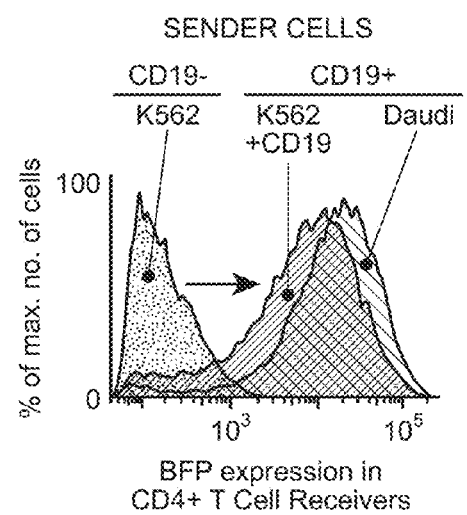
Figure 49C:
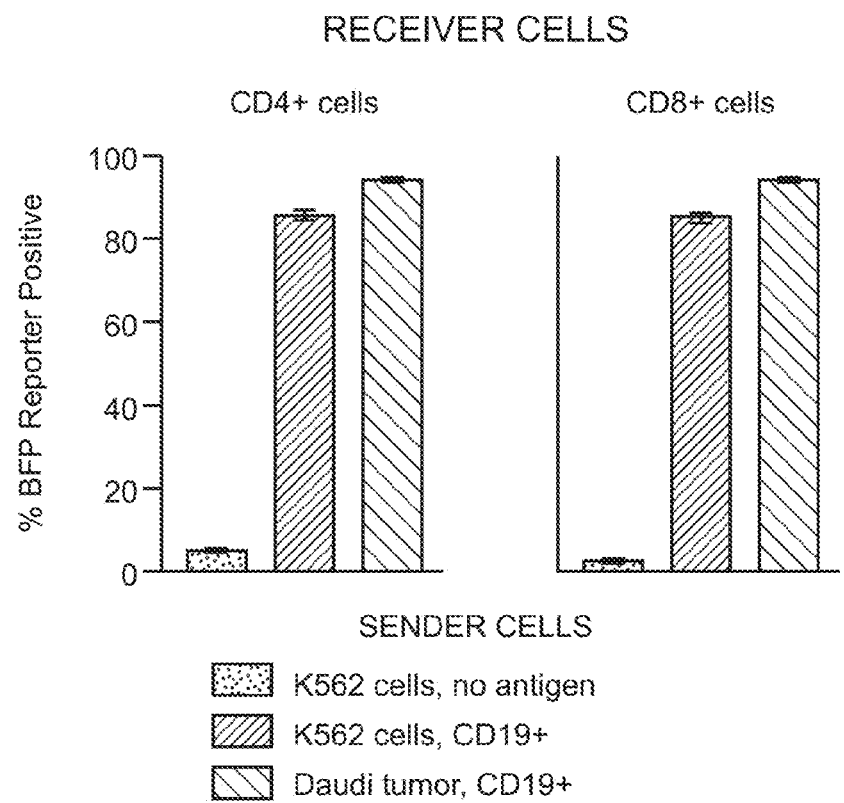
Figure 49D:
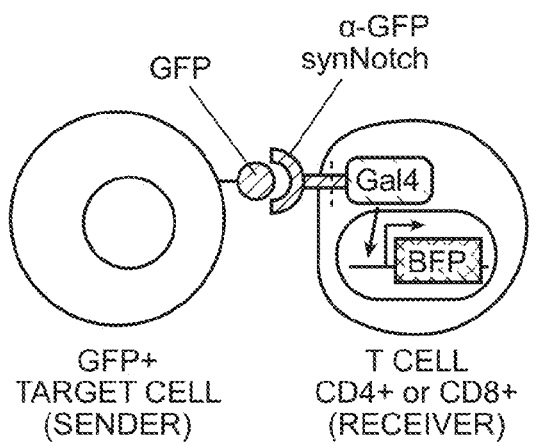
Figure 49F:
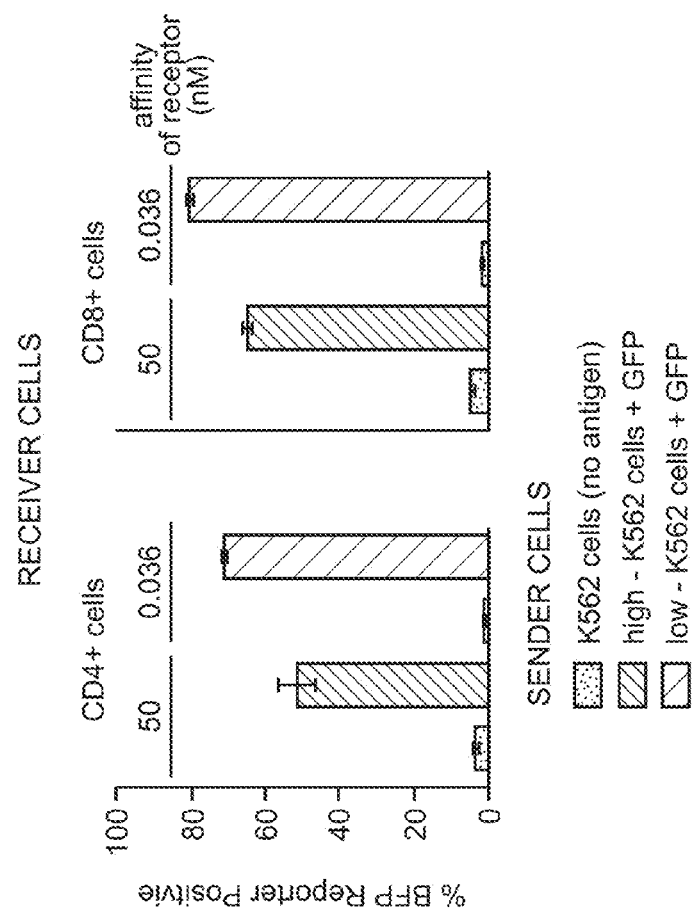
Figure 49E:
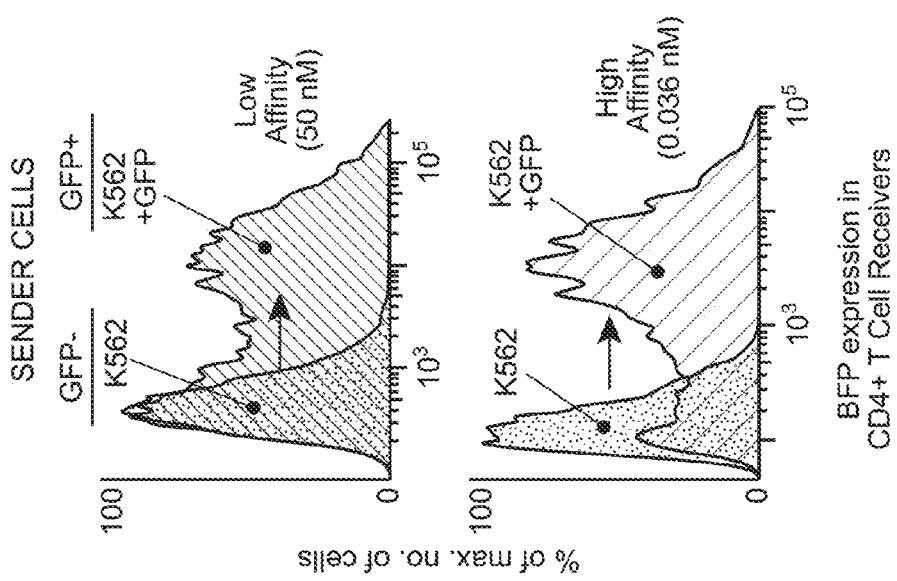
Figure 55A:
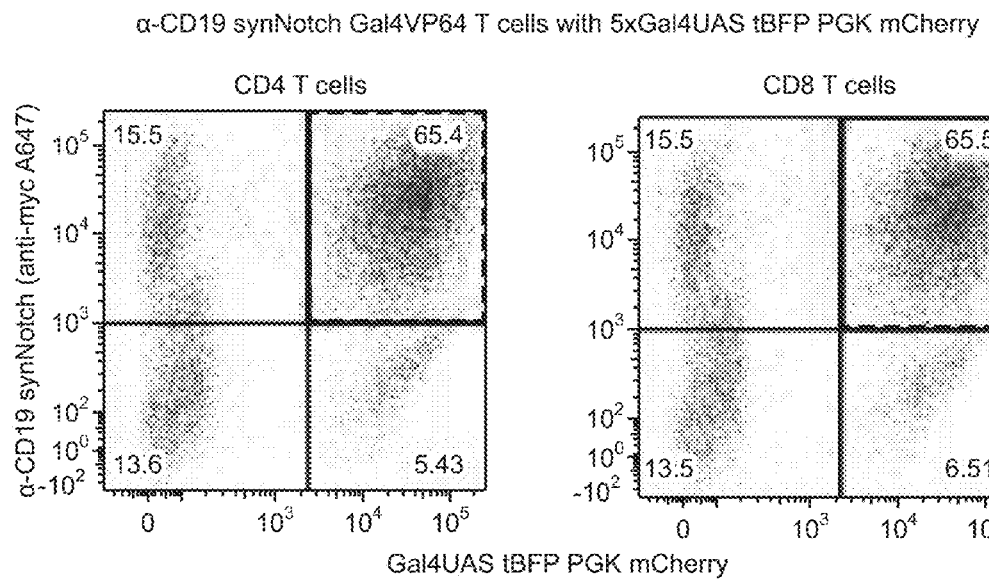
FIGS. 55A-55F provide supplemental data related to FIGS. 49A-49F.
Figure 55B:
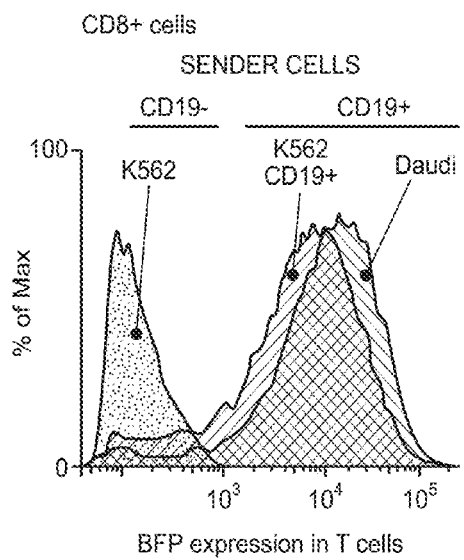
Figure 55C:
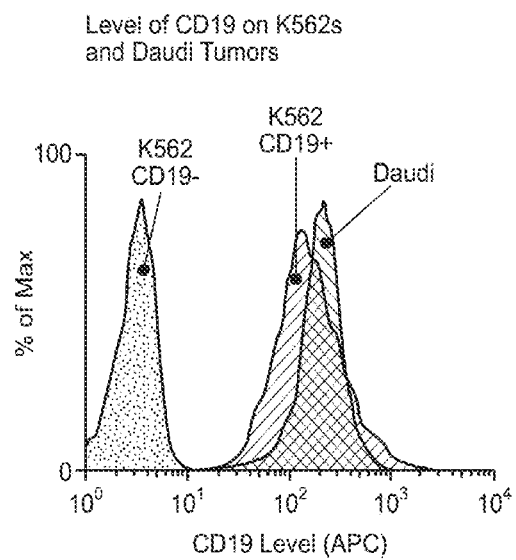
Figure 55D:
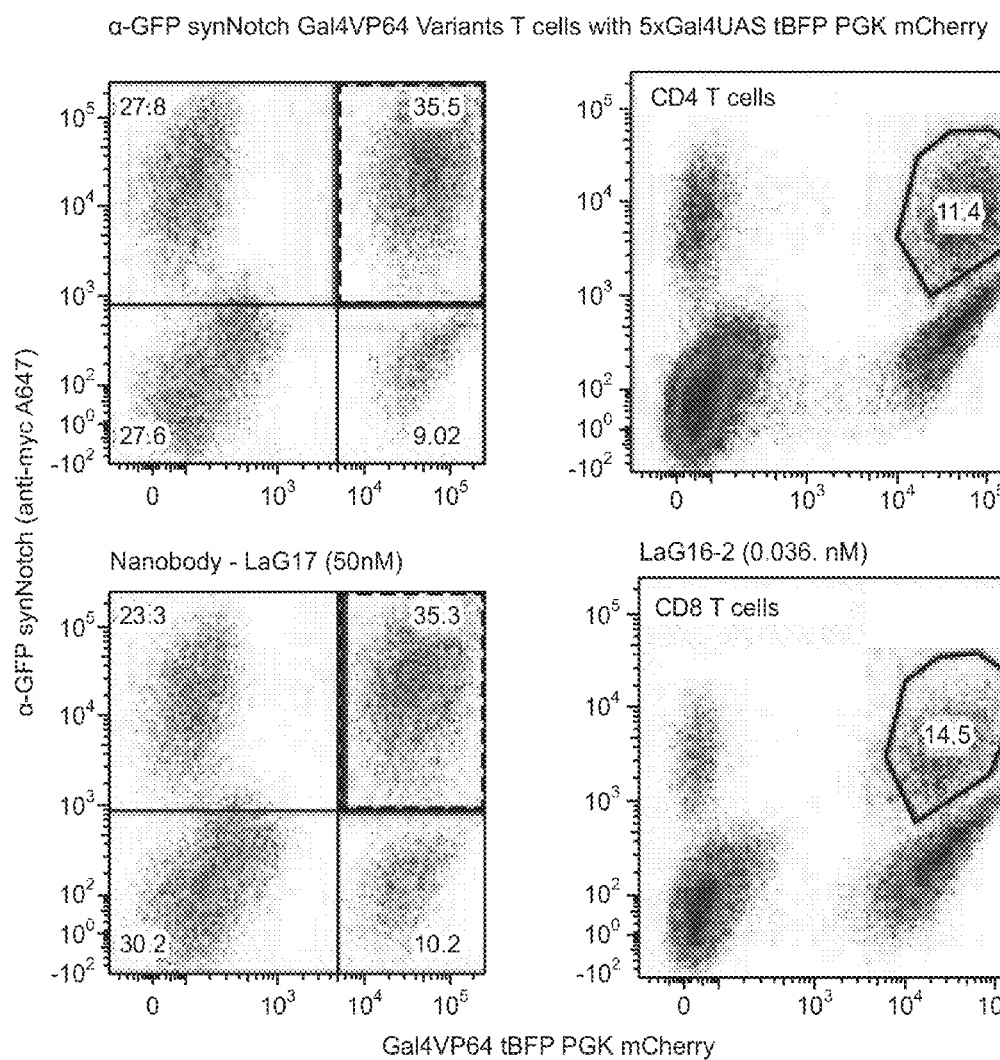
Figure 55E:
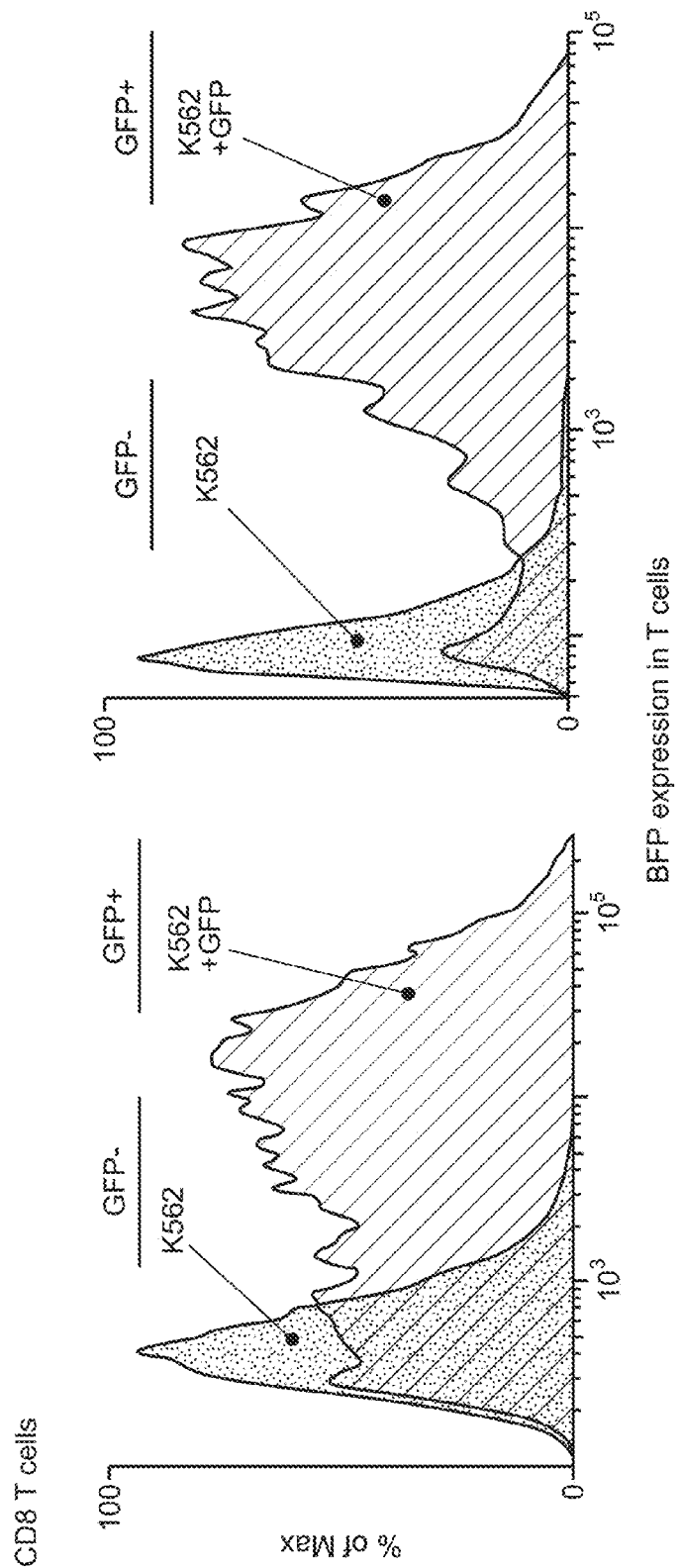
Figure 55F:
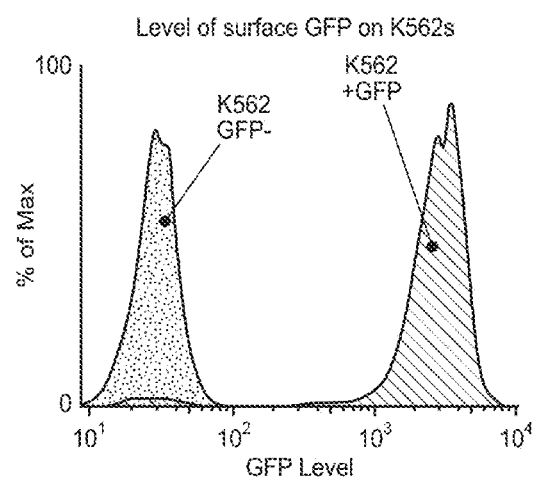

To show that synNotch receptors can function in relevant cell types for cell-based therapy, primary human CD4+ and CD8+ T cells were engineered with synNotch receptors directed towards the cancer-related antigens CD19 or to an orthogonal antigen—surface displayed GFP. CD4+ and CD8+ T cells were engineered to express each synNotch receptor and the associated promoter (5× Gal4 response elements) controlling expression of a BFP reporter gene (FIG. 49). CD4+ and CD8+ T cells engineered with the α-CD19 synNotch receptor drove BFP reporter expression in 80 to 90% of the T cells within 24 hours of co-culture with cells expressing the cognate ligand CD19—either Daudi B cell lymphoblast tumors, which naturally express CD19, or K562 myelogenous leukemia cells with ectopically expressed CD19 (FIGS. 49A-49C and FIG. 55A-55C). These T cells did not show BFP expression when unstimulated or treated with cells that did not express the cognate CD19 antigen. These data show that synNotch receptors can function in a controlled and antigen-dependent manner in primary T cells, and can detect natural levels of antigen on the surface of cancer cells. The synNotch receptors also have equivalent function in CD4+ and CD8+ T cells, which are often used in concert for T cell immunotherapies (FIG. 49C and FIGS. 55A and 55B).

Whether T cells could be engineered to recognize orthogonal surface proteins was also tested by constructing synNotch receptors that recognized surface expressed GFP. Two α-GFP nanobodies that have low (Kd=50 nM) or high affinity (Kd=0.036 nM) (Fridy et al., 2014) were used. These receptors stimulated reporter expression upon exposure to K562 cells expressing surface GFP (but not with cells lacking the antigen). The resulting transcriptional response was similar to that observed for the α-CD19 synNotch, highlighting the modularity of the synNotch platform (FIGS. 49D-49F and FIGS. 55G-55I). The higher affinity α-GFP nanobody synNotch receptor drove a greater fraction of T cells to upregulate reporter expression upon exposure to K562 sender cells, when compared to the lower affinity receptor, yet both receptors activated gene expression in over half of the T cells (FIGS. 49D-49F and FIG. 55H). This suggests that varying the affinity of the synNotch ligand-binding domain can fine tune the magnitude of the cellular response.

synNotch Receptors can Drive Customized T Cell Cytokine Profiles

Figure 50B:
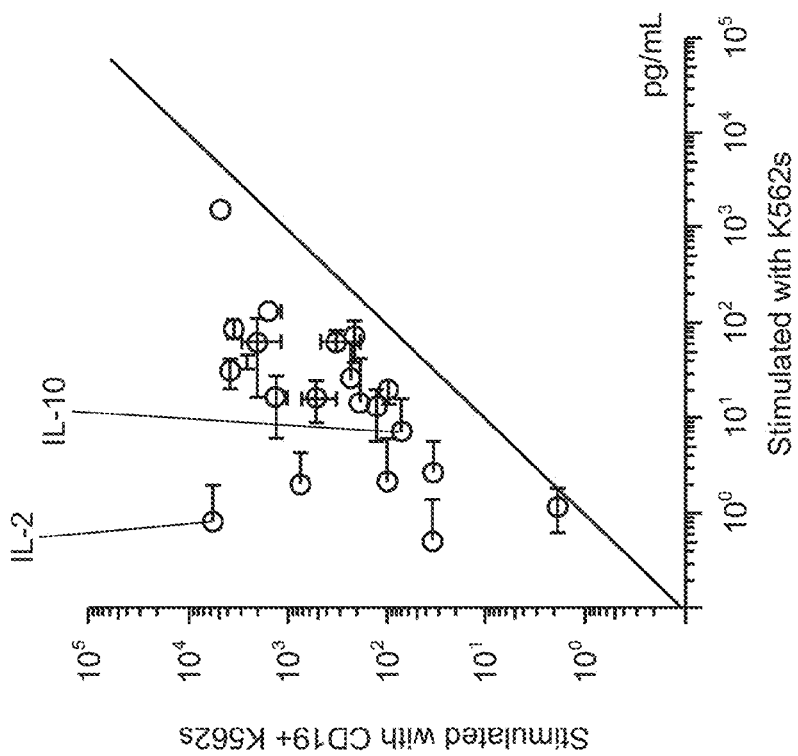
Figure 50A:
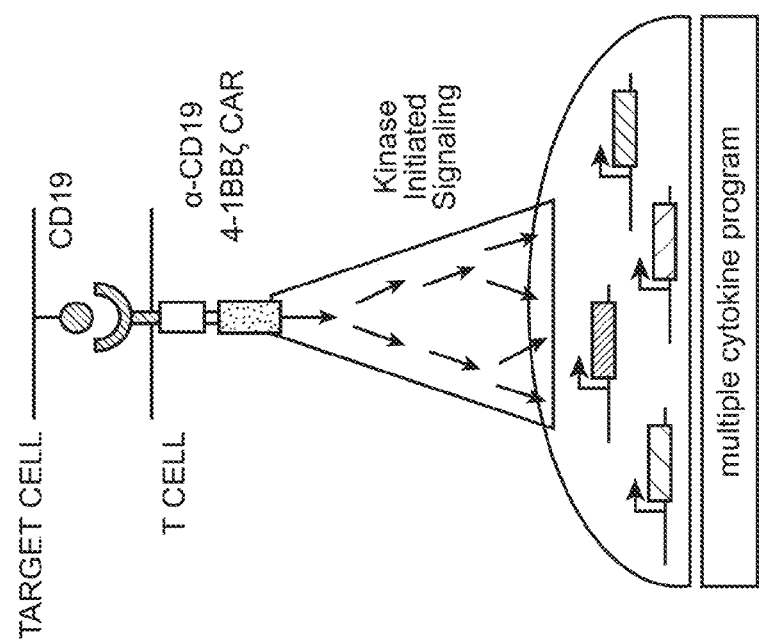

Immune cells and tissues throughout the body secrete soluble proteins known as cytokines to communicate and regulate cell behavior and shape the overall immune response. The specific cytokine profile is critical for eradicating pathogens and tumors. In many cases the different sets of cytokines have the opposite effect of suppressing the immune response. Moreover, in certain scenarios where cytokines could boost immunity towards cancers or suppress damaging inflammation in an autoimmune setting, these cytokines are absent. Precise control of what cytokines therapeutic T cells secrete is desirable. However, in some instances, when T cells are activated through CARs or the natural T cell receptor, there is little control over the cytokines that are produced and often cytokine profile depends on the disease and activation context as well as the receptor characteristics (FIG. 50A-50C). For many T cell therapies, it may be beneficial to bias towards the production of specific cytokines to tailor the immune response for a specific disease or therapeutic need.

Figure 50D:
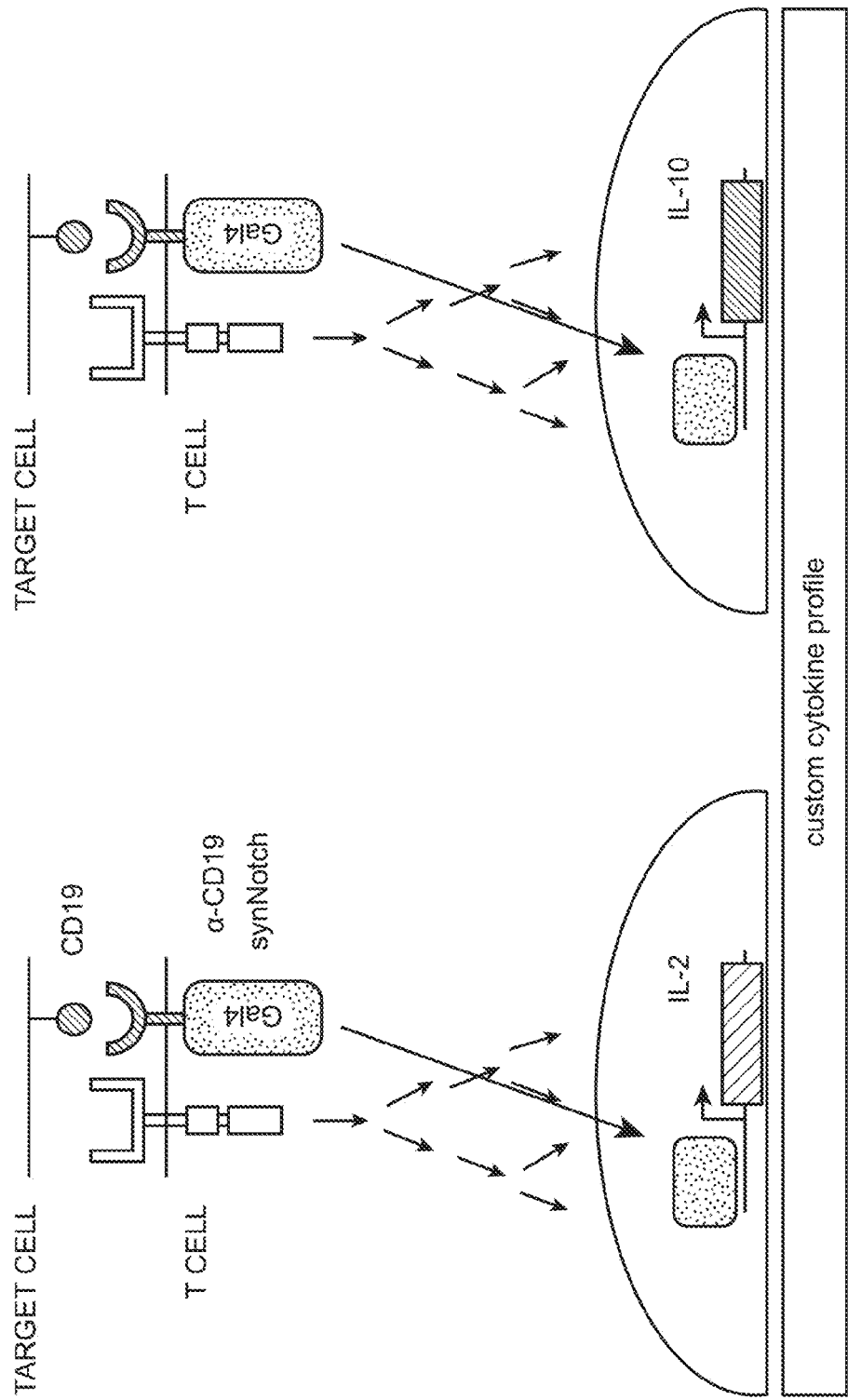
Figure 50E:
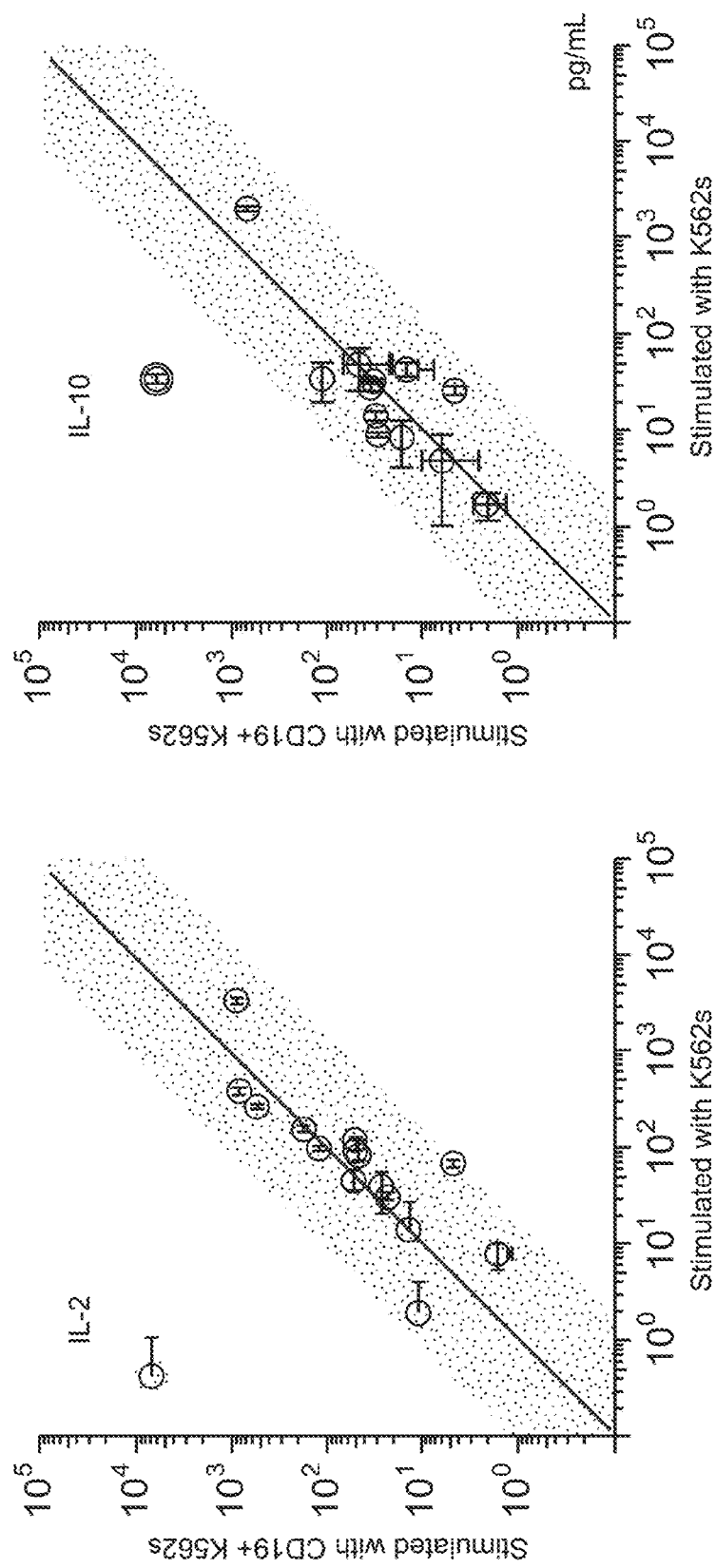
Figure 50F:
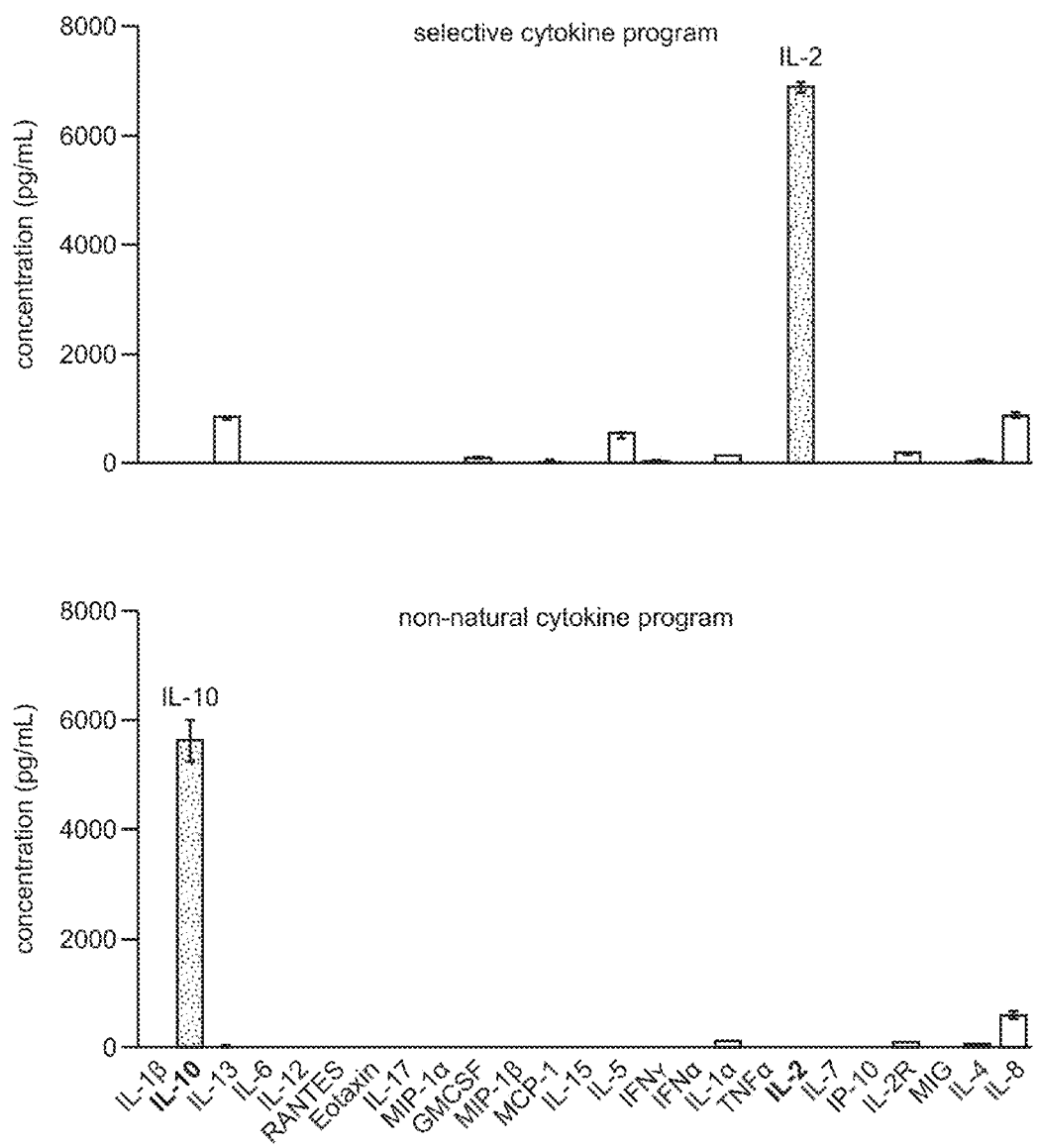
Figure 56A:
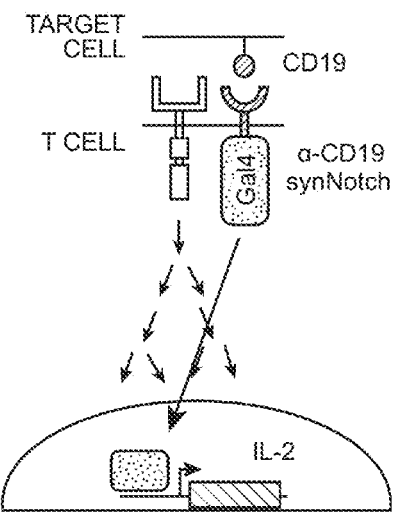
FIGS. 56A-56I provide supplemental data related to FIGS. 50A-50F.
Figure 56B:
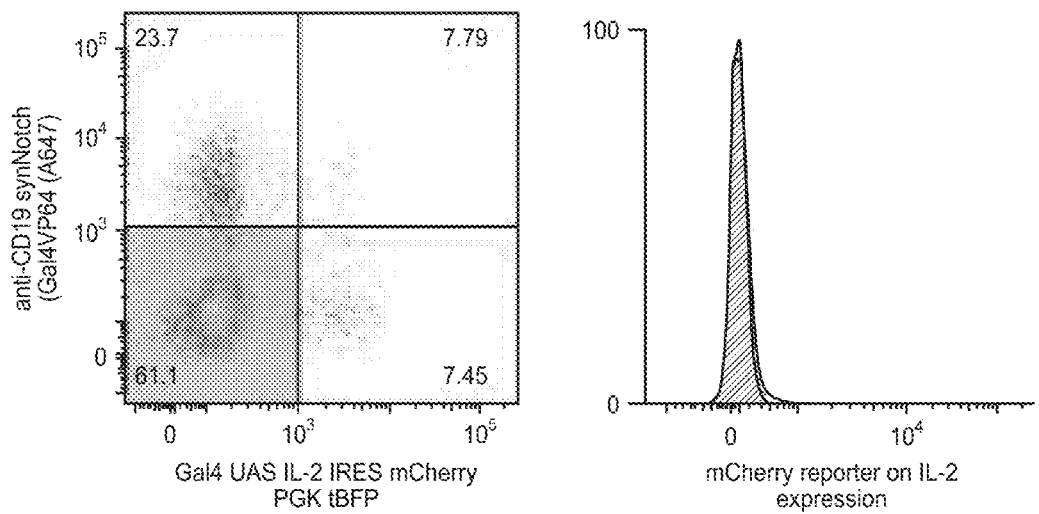
Figure 56C:
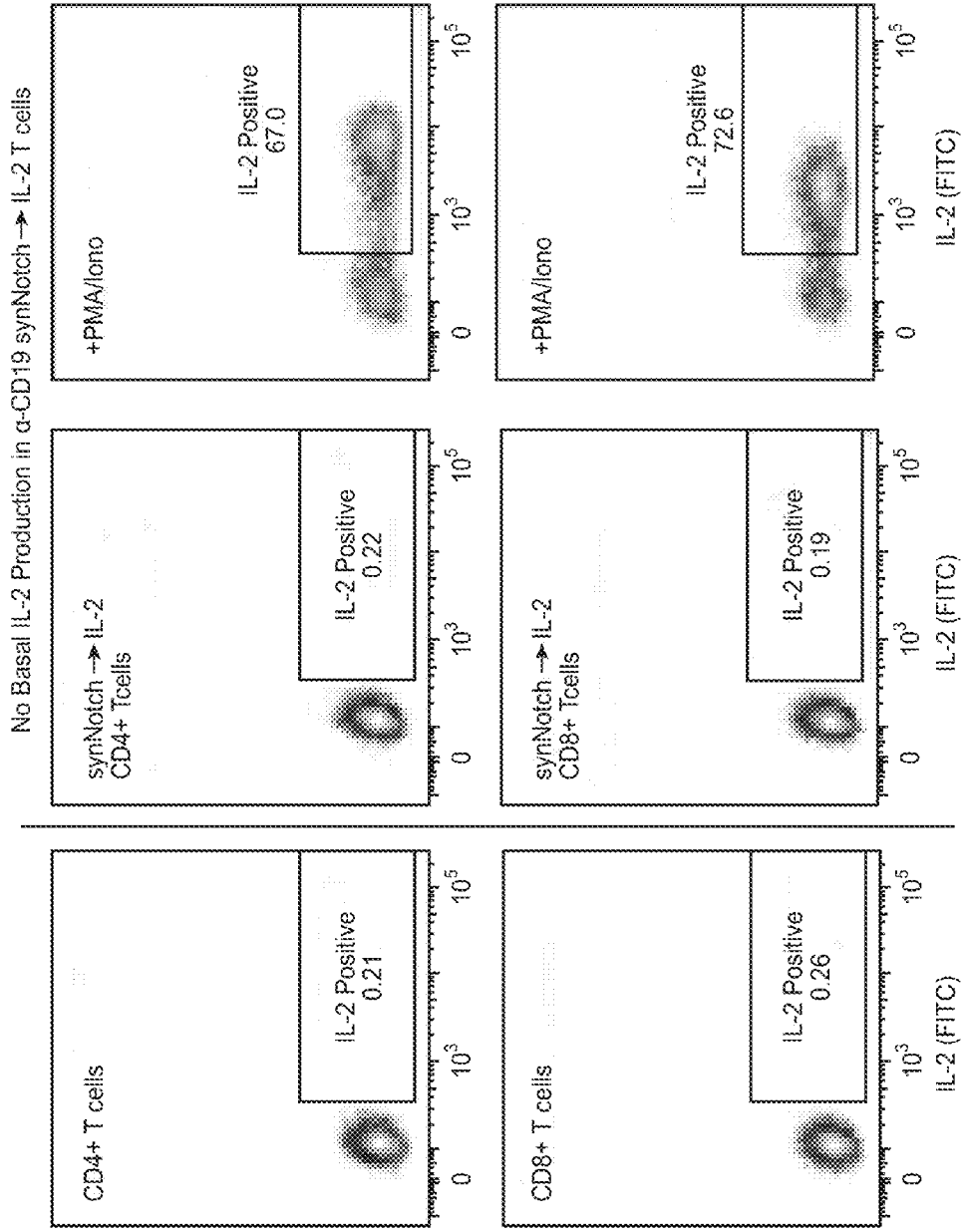
Figure 56D:
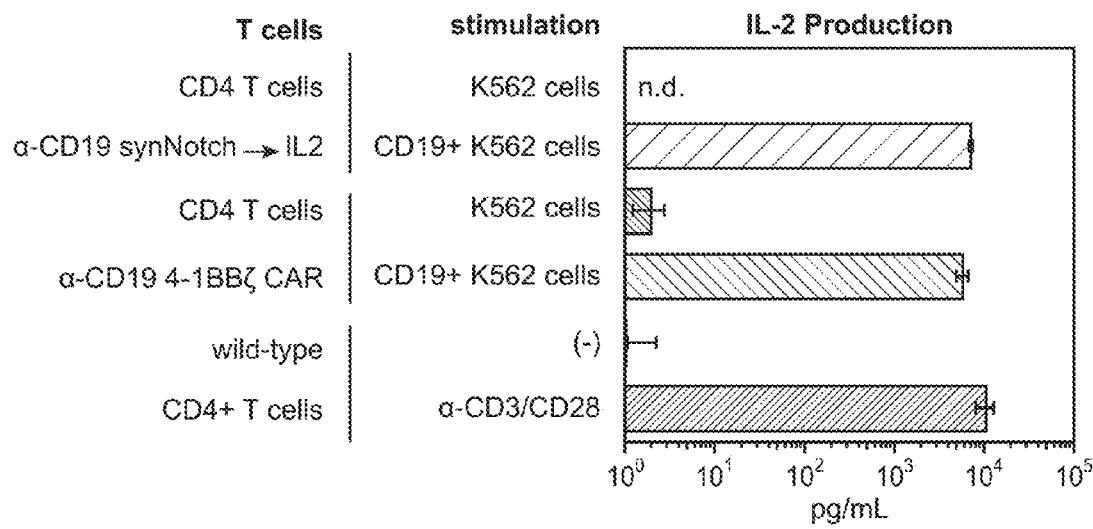
Figure 56E:
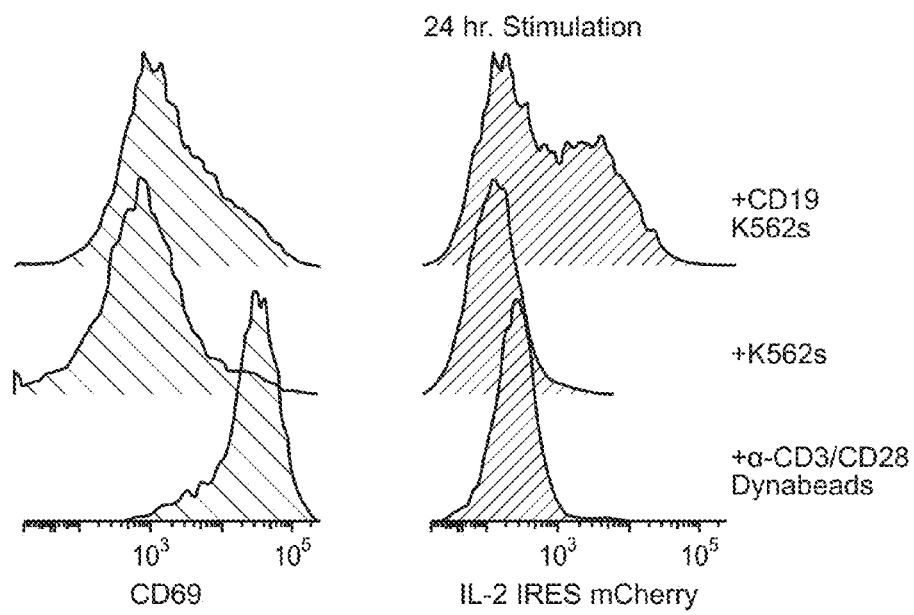
Figure 56F:
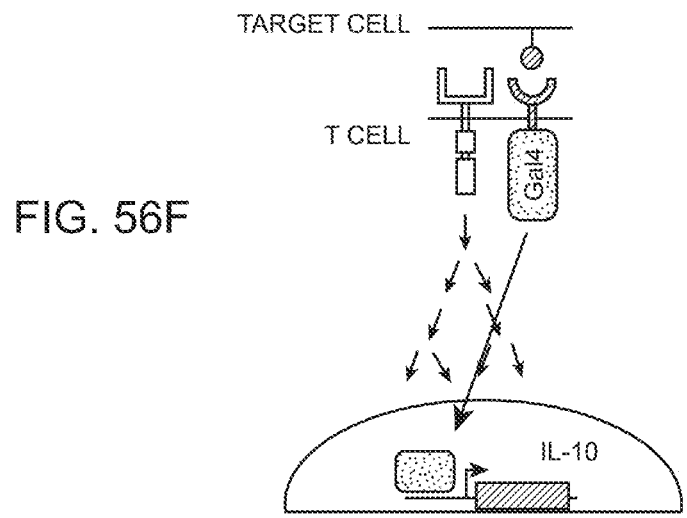
Figure 56G:
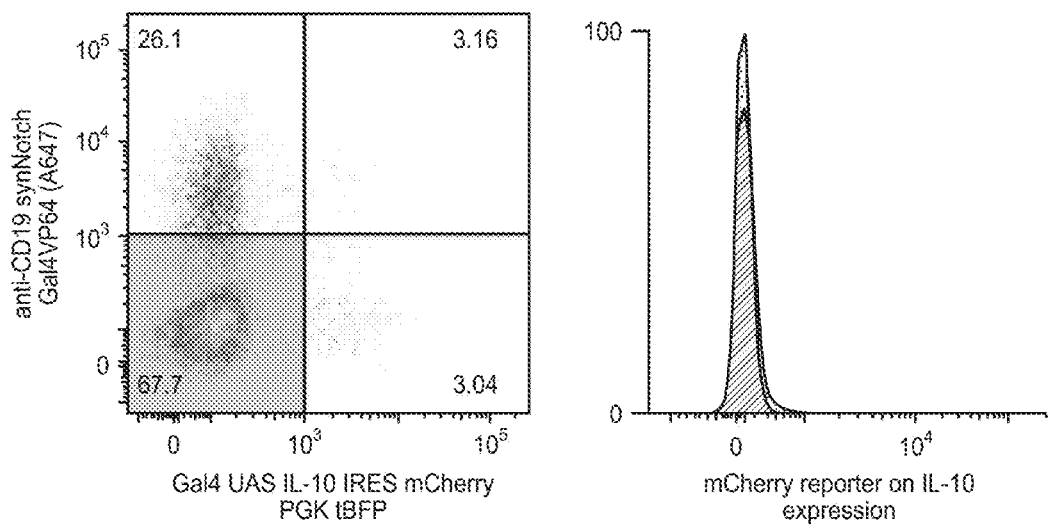
Figure 56H:
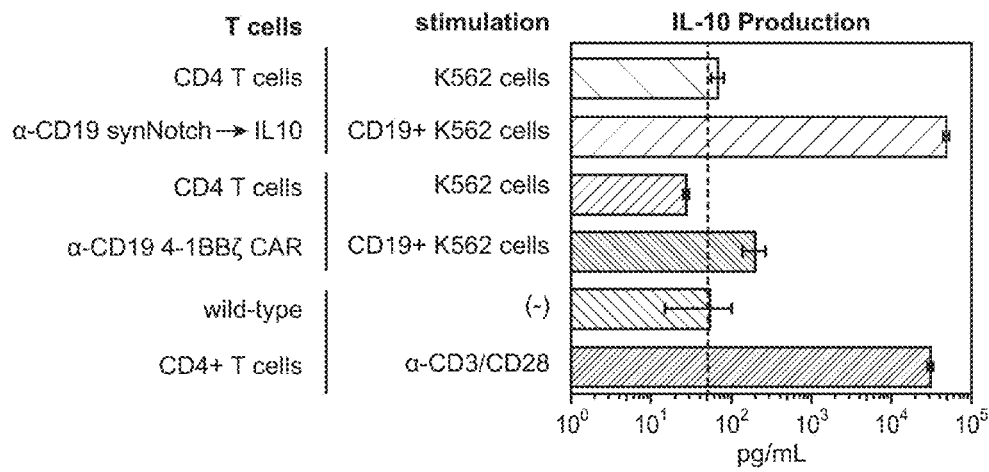
Figure 56I:
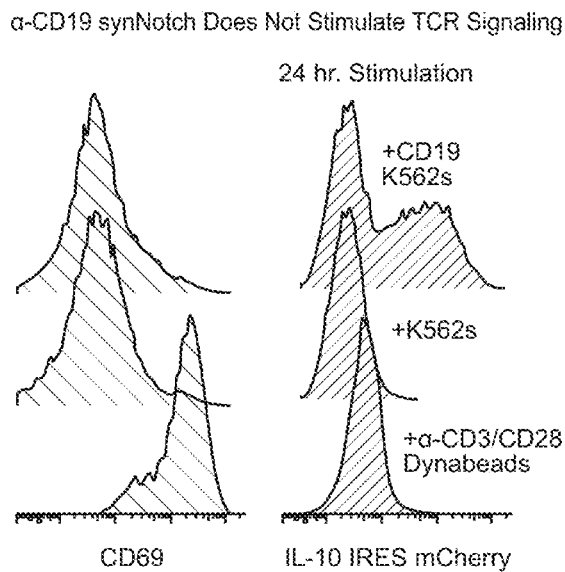

With this in mind, CD4+ T cells were engineered with the α-CD19 synNotch receptor and the corresponding transcriptional response element controlling the expression of a single cytokine. Under these conditions, T cells selectively produced only a defined "a la carte" cytokine profile in response to the CD19 antigen (FIG. 50D-50F). synNotch receptors drove high-level production of the T cell stimulatory cytokine IL-2 with no basal secretion prior to antigen sensing (FIG. 56A-56D). The amount of IL-2 produced by synNotch activation is similar to what is produced in response to CAR or TCR stimulation (α-CD3/α-CD28 beads) of T cells (FIG. 56D). Unlike normal stimulation of T cells through the TCR pathway, synNotch-driven cytokine production does not lead to T cell activation, shown by the lack of upregulation of the activation marker CD69 (FIG. 56E).

Figure 51A:
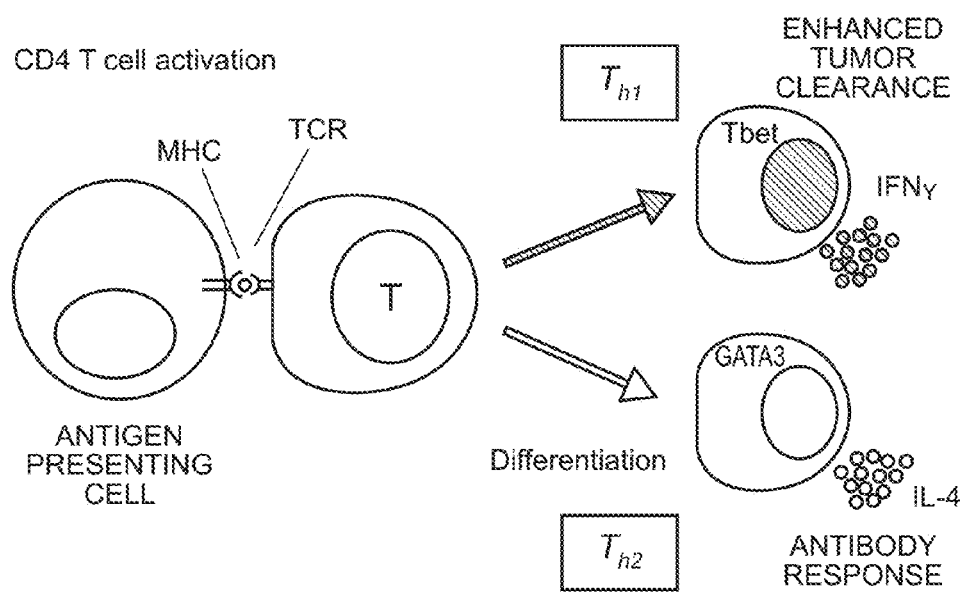
Figure 51B:
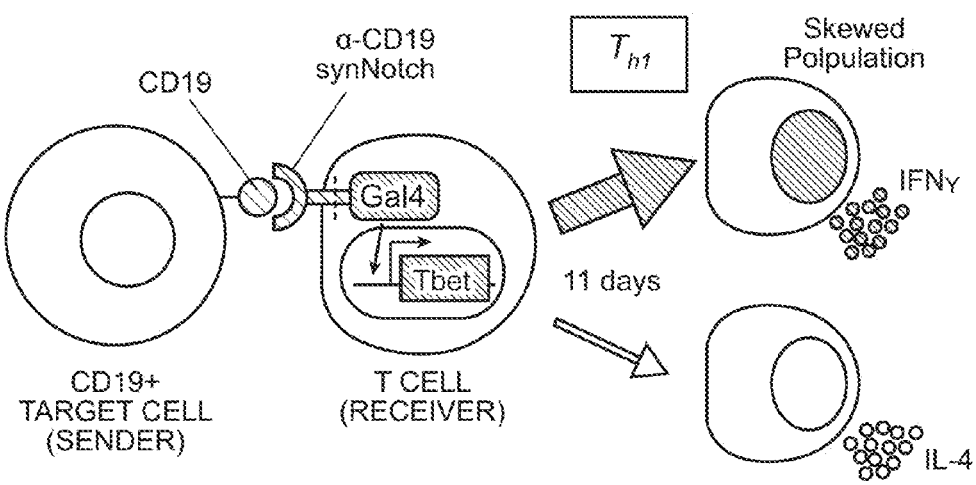

T cells were engineered to produce the immunosuppressive cytokine IL-10 (FIGS. 50D-50F and FIGS. 56F-56H), which unlike IL-2, was absent from the cytokine profile of activated CAR T cells (FIG. 50C). This highlights an application of synNotch receptors—the ability to add or modulate levels of a particular cytokine, even one that is not naturally expressed (FIG. 50 and FIG. 56). Moreover, such responses do not require normal activation of the T cell. The customizability and precision of synNotch circuits in T cells should allow for local control of immune system functions that rely on autocrine and paracrine cellular communication to effectively coordinate a response to disease.

synNotch Receptors can Drive Antigen-Dependent Skewing of T Cell Differentiation to the Anti-Tumor $T_{h1}$ Fate Another way to precisely shape the output of a therapeutic T cell is to control its differentiation. Beyond producing protein effectors like cytokines, T cells undergo specific differentiation programs important for mounting an effective subtype immune response. These subtype differentiation programs are normally determined by the combination of T cell activation, particular cytokines, and ultimately the regulation of master regulator transcription factors that initiate the specific T cell fate. T helper cell 1 ($T_{h1}$) or T helper cell 2 ($T_{h2}$) T cells are two canonical CD4+ T cell fate choices that are controlled by the master regulator transcription factors, Tbet and GATA3, respectively (FIG. 51A). $T_{h1}$ cells are important for cellular immunity towards pathogens and cancer whereas $T_{h2}$ cells are involved in stimulation of antibody production. In many diseases, the local environment skews the differentiation of T cells along the wrong path such that they are rendered ineffective. This is especially true in cancer where T cells can be pushed into a suppressive phenotype, hampering the immune response and leading to tumor expansion.

Figure 59A:
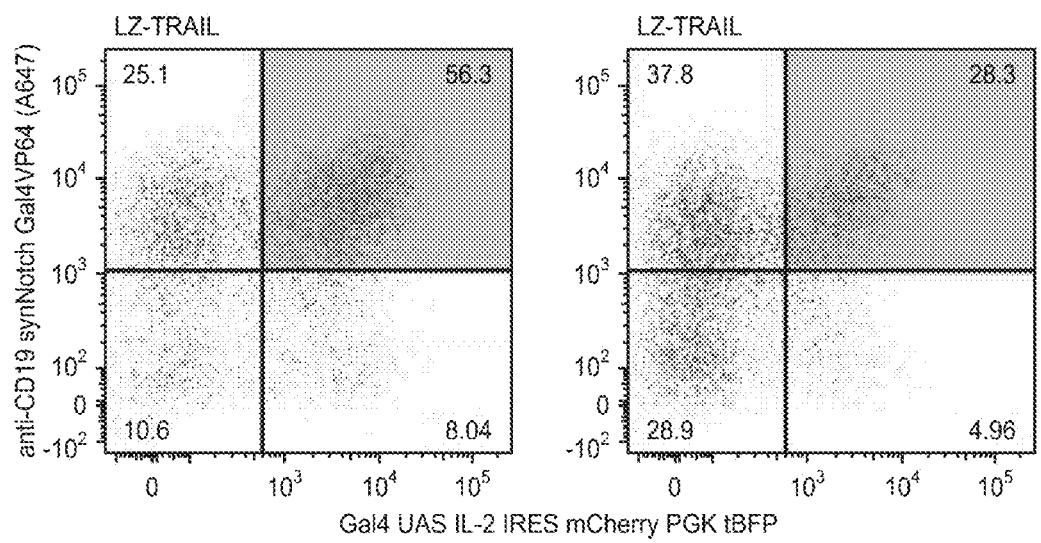
Figure 59B:
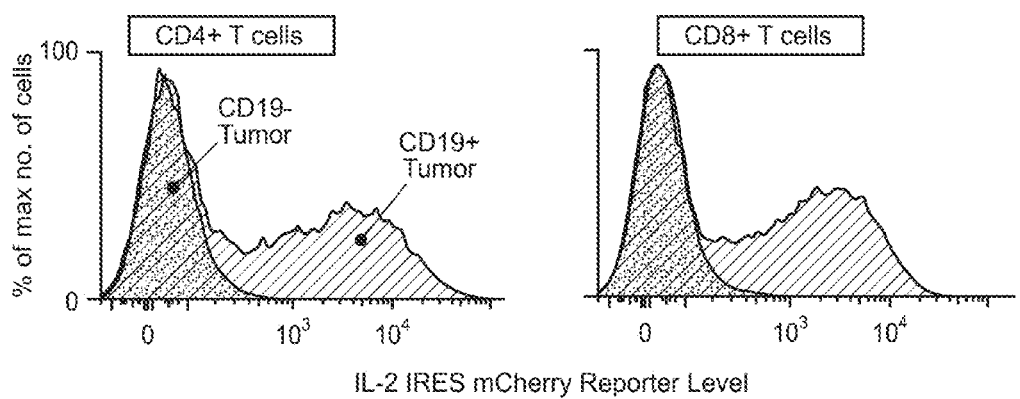

Given the importance of T cell fate choice for cancer clearance, if synNotch receptors could skew T cells to differentiate into IFNγ producing $T_{h1}$ cells, important for anti-cancer immunity, was investigated. IFNγ is critical for activation of innate immune cells that aid in tumor clearance, such as macrophages and dendritic cells, and direct exposure of cancer cells to IFNγ can enhance their susceptibility to the cytotoxic T cells. To skew T cell differentiation, CD4+ T cells were engineered with the α-CD19 synNotch receptor that controlled the expression of the $T_{h1}$ transcription factor, Tbet (Figure. 59B). Since ectopic expression of Tbet is known to be sufficient to drive the $T_{h1}$ fate choice in CD4+ T cells, it was reasoned that synNotch could provide antigen-dependent control over $T_{h1}$ fate regulation by regulating the levels of Tbet in response to the tumor antigen CD19.

Figure 51C:
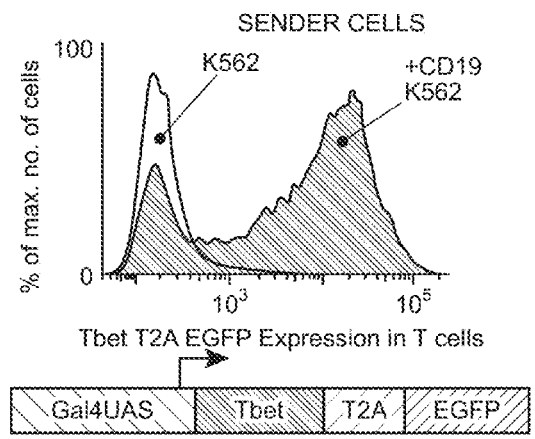
Figure 51D:
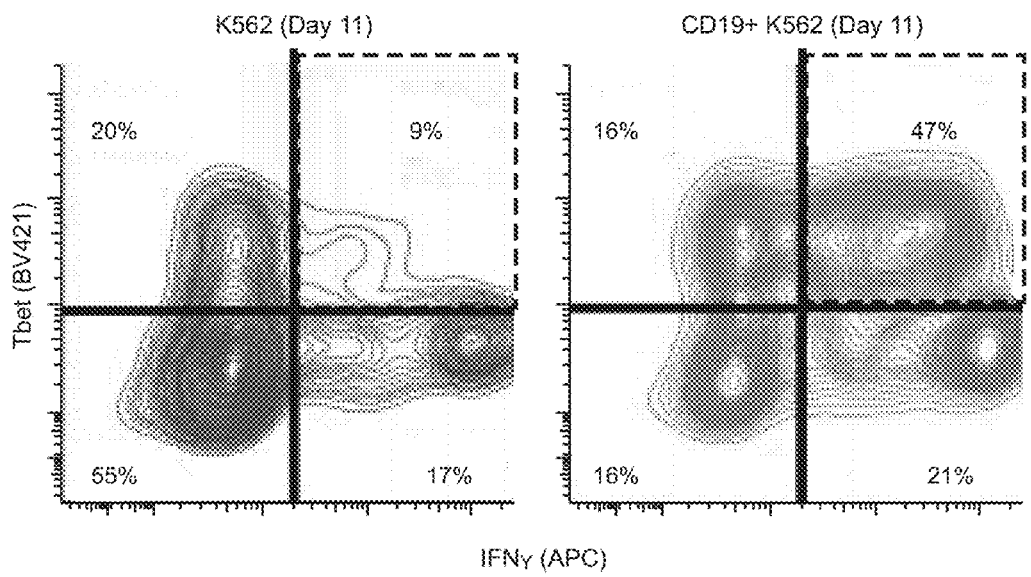
Figure 57A:
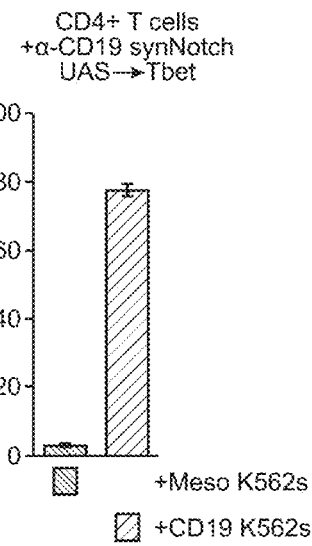
FIGS. 57A-57G provide supplemental data related to FIGS. 51A-51E.
Figure 57B:
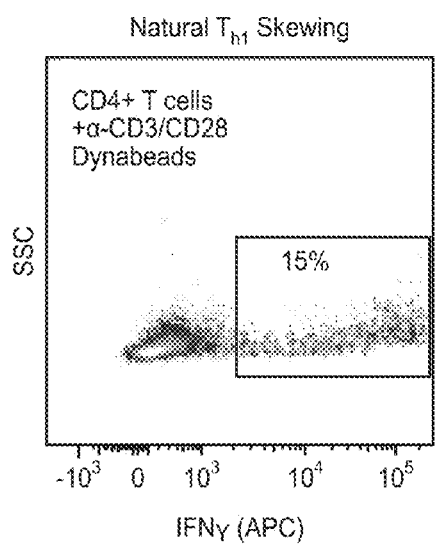
Figure 57C:
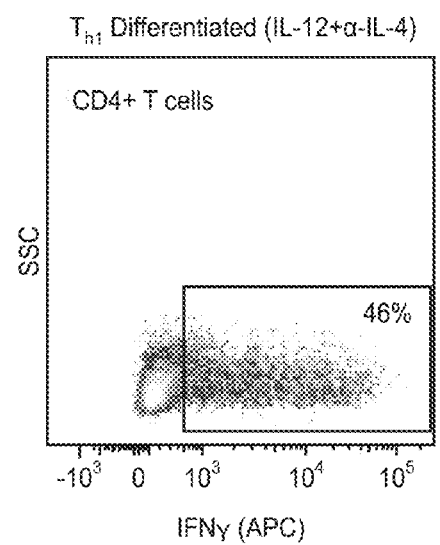
Figure 57D:
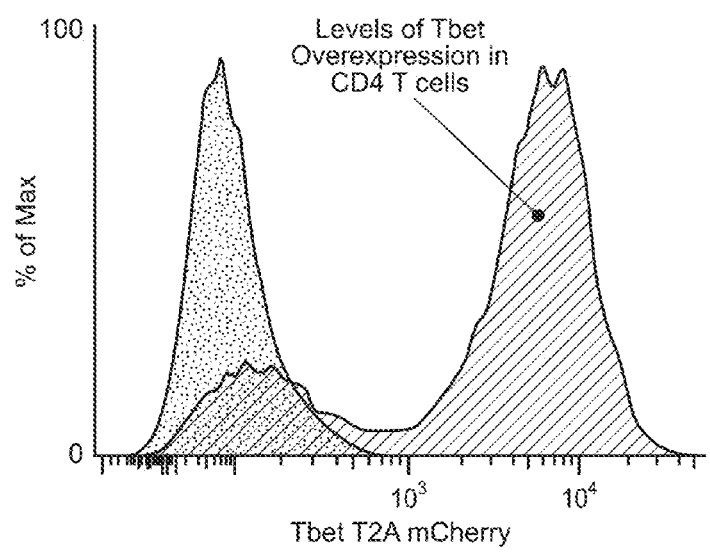
Figure 57F:
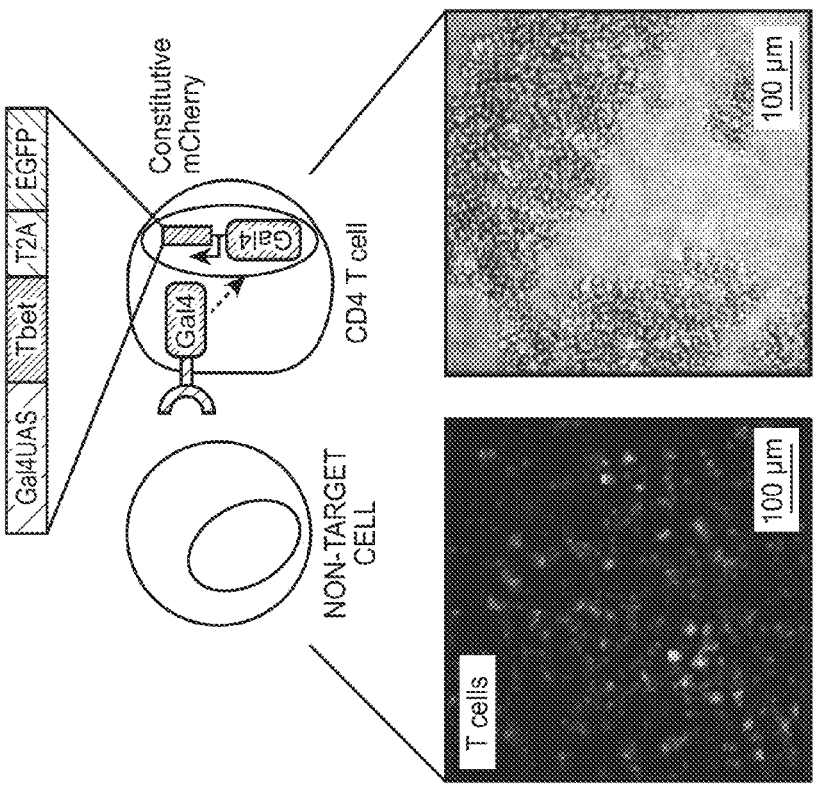
Figure 57E:
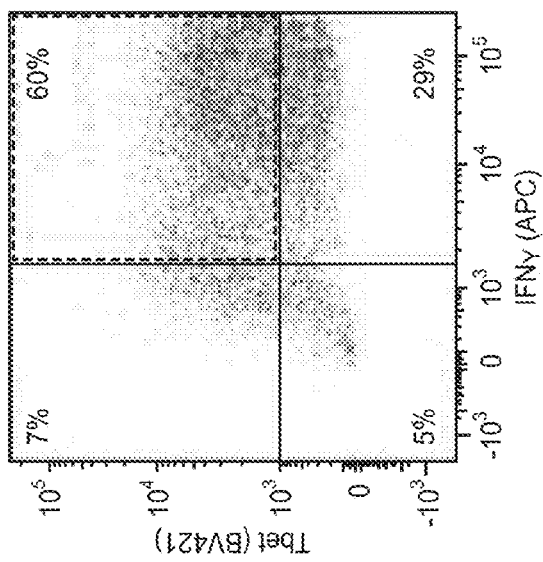
Figure 57G:
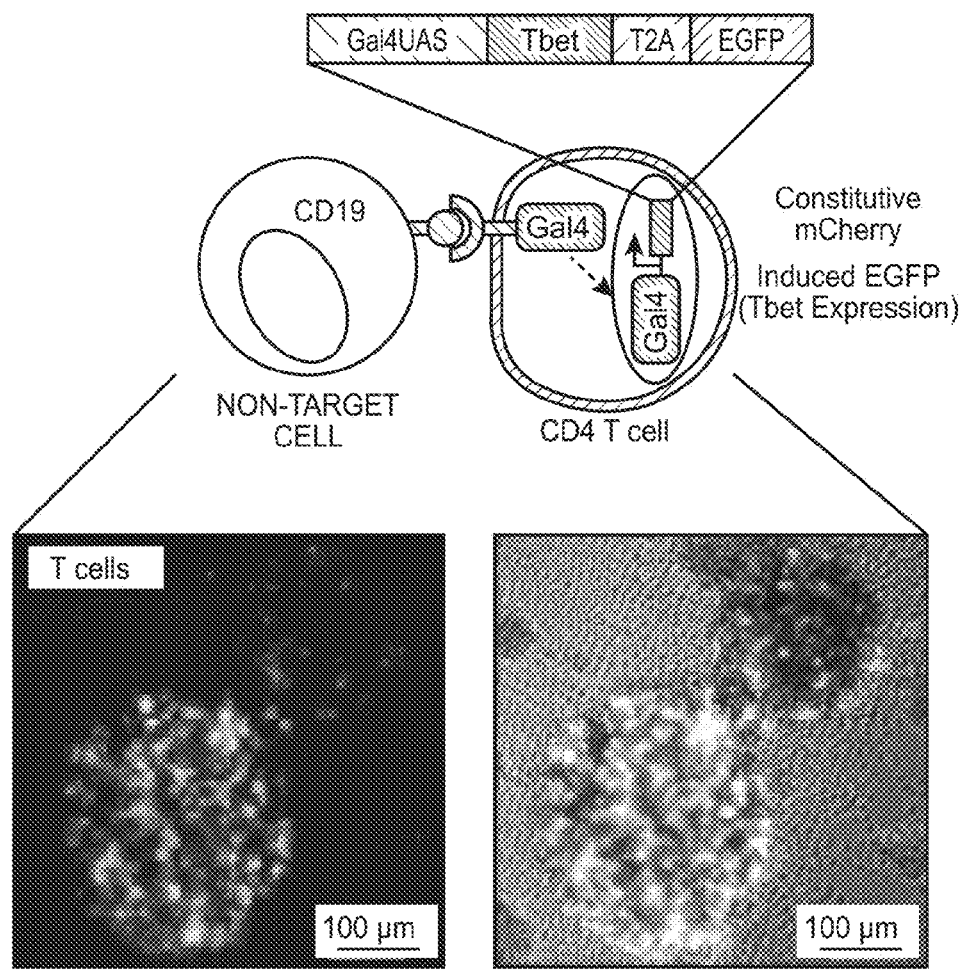

To test this, the engineered primary CD4+ T cells were co-cultured with either CD19+ target K562 cells or CD19− control K562 cells for 11 days to induce differentiation. As comparative controls, a matched population of CD4+ T cells were either treated with a cocktail of $T_{h1}$ differentiation agents (IL-12 and α-IL-4) or subject to Tbet constitutive overexpression. These two conditions allowed for the comparison of synNotch driven $T_{h1}$ differentiation to previous gold standards in the field. The engineered synNotch CD4+ T cells expressed Tbet in response to CD19 within 24 hours of stimulation (FIG. 51C and FIG. 57A). After 11 days of long-term co-culture with CD19+ K562s, the T cells were stimulated with Phorbal myristate acetate (PMA) and ionomycin for intracellular cytokine staining to reveal whether the T cells had become $T_{h1}$ cells. For the T cells that had been stimulated with CD19+ K562 cell for 11 days, >60% were found to be IFNγ+$T_{h1}$ cells (FIG. 51D). This magnitude of skewed differentiation was equivalent to what was observed with treatment with the $T_{h1}$ differentiation cocktail and only slightly less than with constitutive Tbet overexpression (FIG. 51E and FIG. 57A-57E). Thus, synNotch receptors can be used to skew T cells to the anti-tumor $T_{h1}$ fate, and could in principle be used to skew T cells to many of the known T cell fates (e.g. $T_{h2}$, $T_{reg}$, $T_{h17}$) as long as the expression of the defining master regulator transcription factor is sufficient for fate determination.

SynNotch Driven T Cell Delivery of Custom Therapeutics—TRAIL Production

Figure 52C:
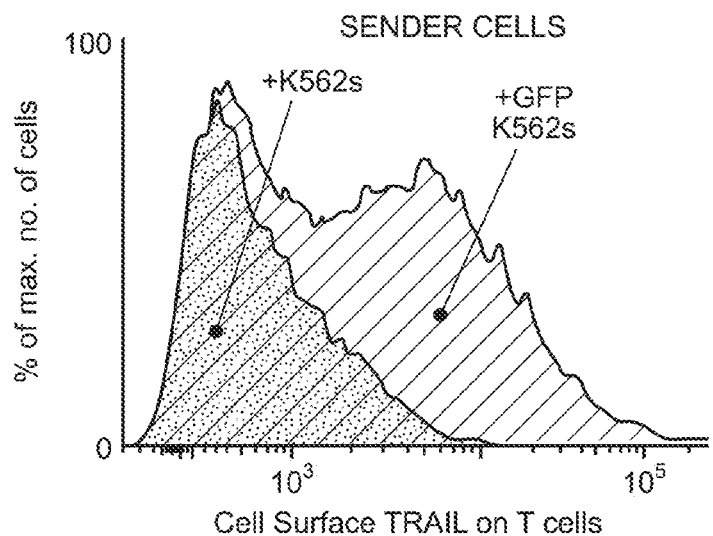

Another important component of future T cell therapeutics is to engineer T cells with new capabilities that allow them to deliver customized therapeutic payloads, even ones that are non-native. Natural T cells or CAR T cells directly recognize infected cells or cancer cells and kill them through the delivery of lytic granules (FIG. 52A). However, natural T cell responses are often insufficient or too extreme to eradicate disease safely. Custom delivery of therapeutic payloads by T cells, such as secreted biologics could aid in difficult to treat diseases by, for example, locally enhancing cytotoxic activity or by priming the site of disease to be recognized and killed by the immune system.

Figure 52D:
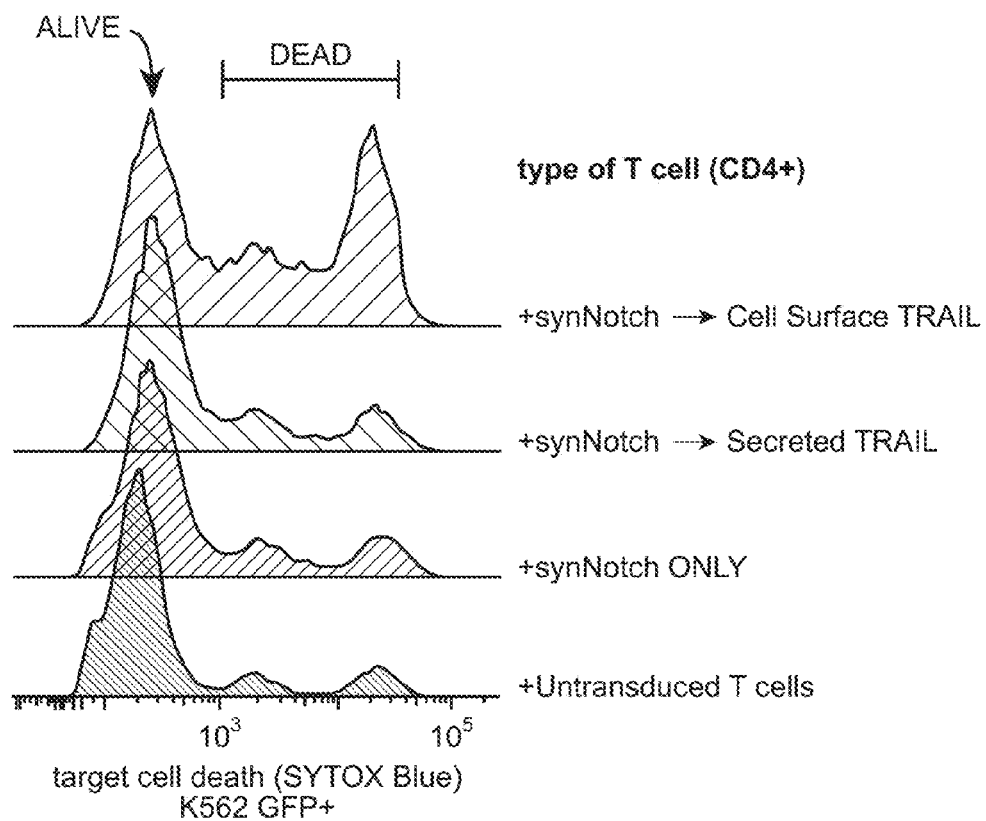
Figure 52E:
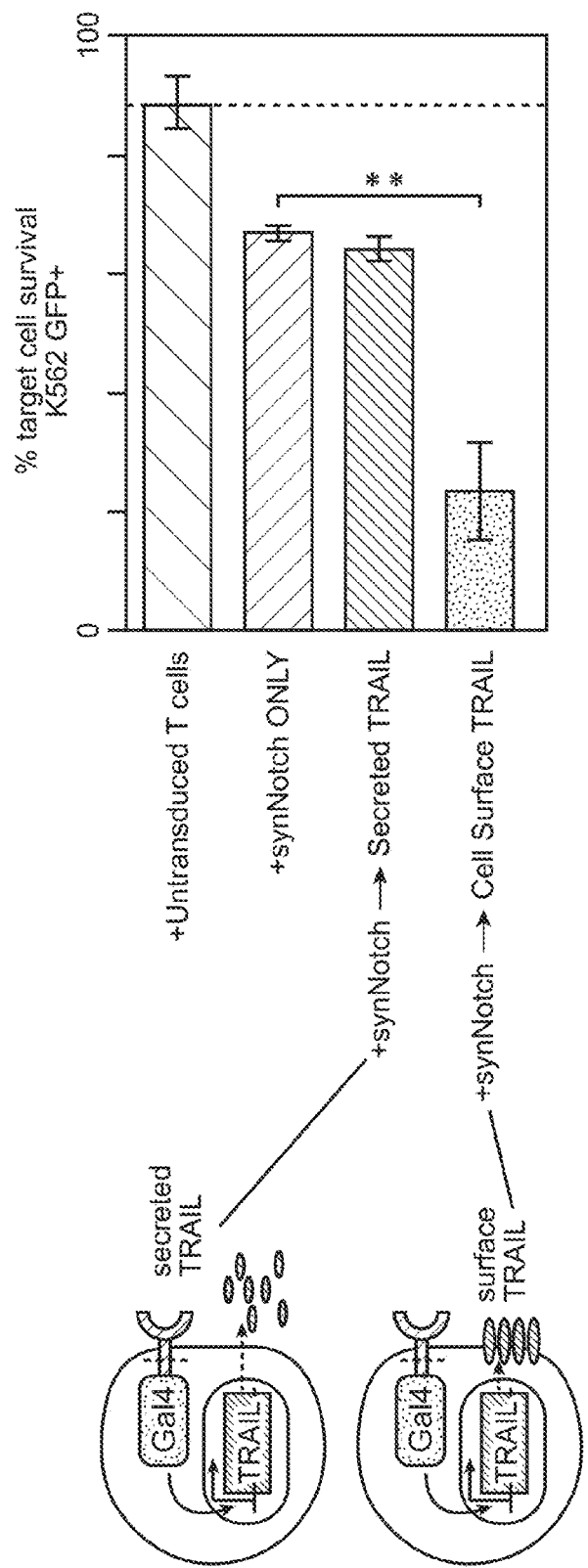
Figure 58A:
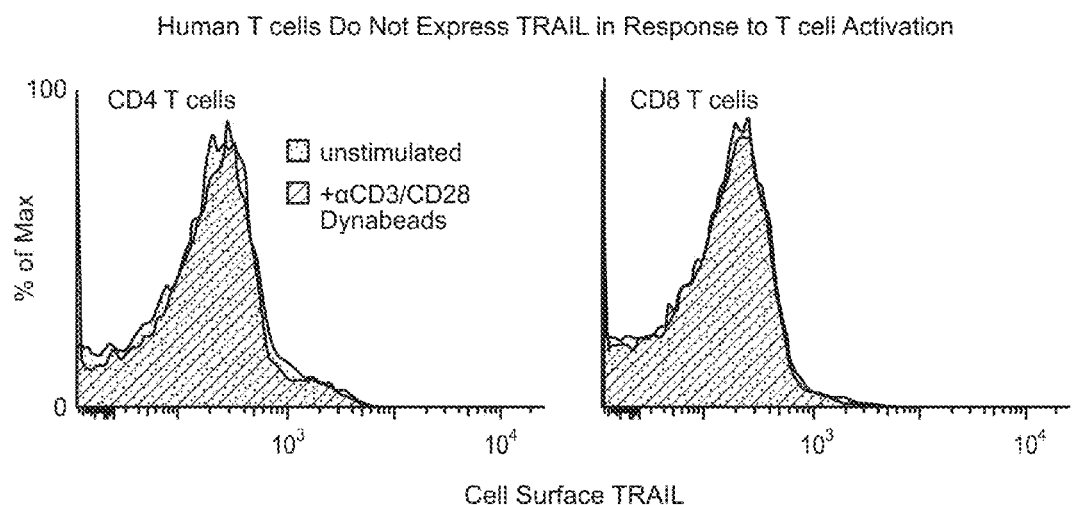
Figure 58B:
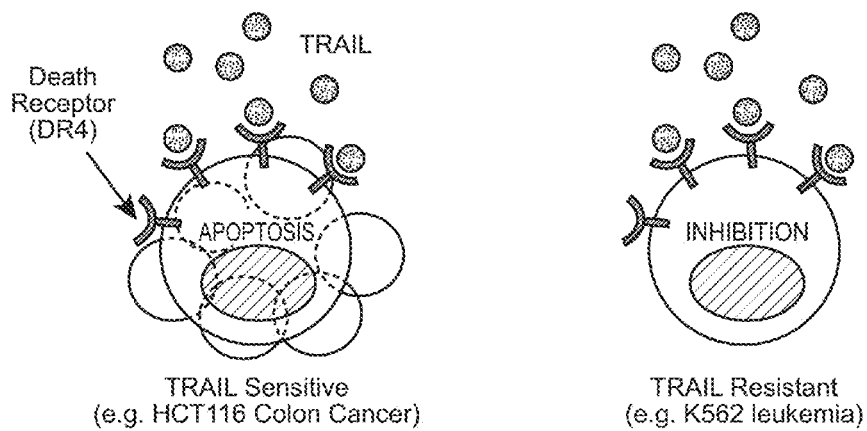
Figure 58C:
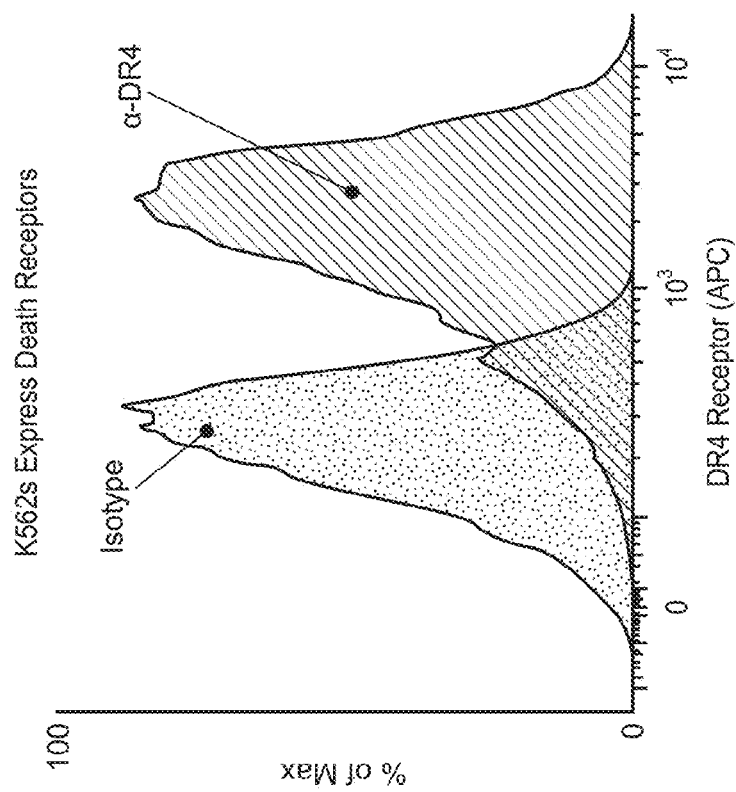
Figure 58D:
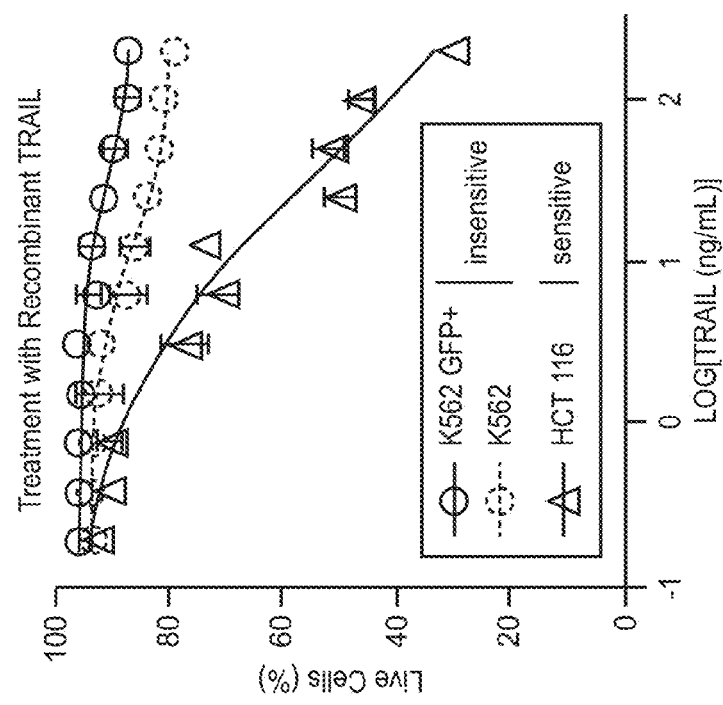
Figure 58F:
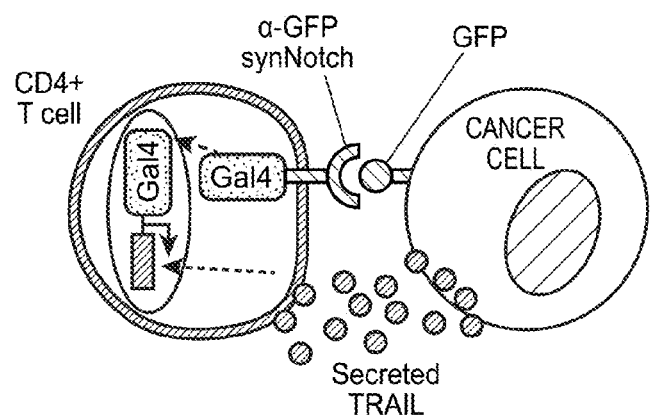
Figure 58G:
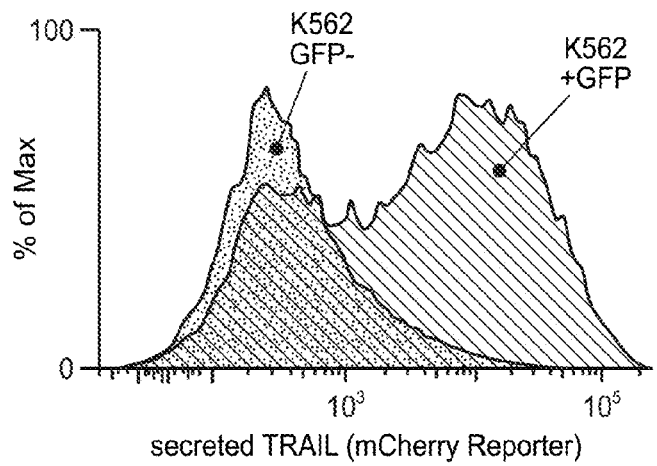
Figure 58H:
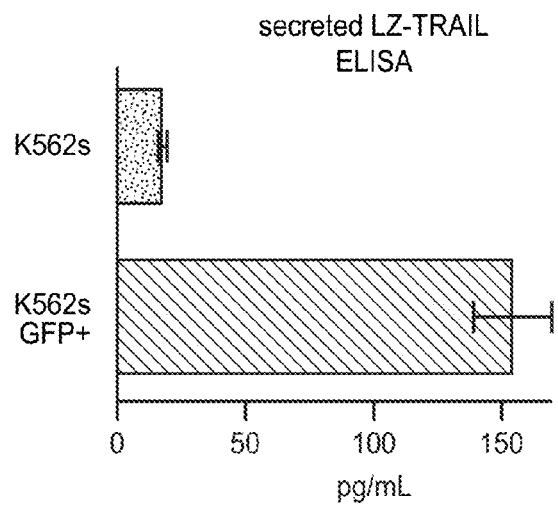

As a proof of principle experiment, the engineering of CD4+ T cells—a T cell subset that is minimally cytotoxic—into a synthetic "killer T cell" by designing it to produce an apoptosis inducing payload was investigated. The α-GFP nanobody synNotch receptor and response elements controlling production of Tumor Necrosis Factor Receptor ligand (TRAIL), an inducer of apoptosis and a cancer therapeutic, were used (FIG. 52B). T cells do not normally produce TRAIL upon TCR stimulation, therefore, if synthetically expressed in a controlled manner, this could aid in their cytotoxic activity (FIG. 58A). Soluble forms of TRAIL are effective at killing the highly susceptible colon cancer cell line HCT116, but for other cancer lines like K562 cells, soluble TRAIL does not induce apoptosis even at high doses (FIG. 58A-58D). However, a recent study showed that if TRAIL is delivered in a membrane anchored form (e.g., a supported lipid bilayer or liposome), it is more effective at inducing apoptosis, even for resistant cancer cells such as K562 cells. Therefore, the CD4+ T cells were engineered to produce one of two TRAIL variants: 1) a secreted form of TRAIL fused to the GCN4 trimeric leucine zipper (LZ-TRAIL) known to be more potent than soluble monomeric TRAIL, or 2) a natural surface displayed TRAIL (FIG. 58E-58H).

synNotch T cells driving TRAIL production were co-cultured with TRAIL-resistant K562 cells to determine if T cells were an effective delivery platform that enhanced the apoptotic effects of TRAIL. synNotch T cells drove cell surface TRAIL expression (FIG. 52C) and LZ-TRAIL secretion within 24 hours of co-culture (FIG. 58F-58H), but only cell surface TRAIL initiated K562 cell death, indicated by their uptake of the live/dead stain SYTOX blue. In contrast, synNotch T cells that secreted LZ-TRAIL were not effective at killing the resistant K562 cells, consistent with recent studies (FIG. 52D-52E).

Overall, these findings suggest that synNotch T cells can be efficient and effective delivery agents for therapeutics such as TRAIL. Any biologic agent that has been ineffective or toxic when systemically delivered, might be more effective and safer if locally delivered in this manner synNotch engineered T cells have the potential to locally deliver any genetically encoded therapeutic agents for enhanced effectiveness and reduced systemic OFF-target toxicity.

Figure 53A:
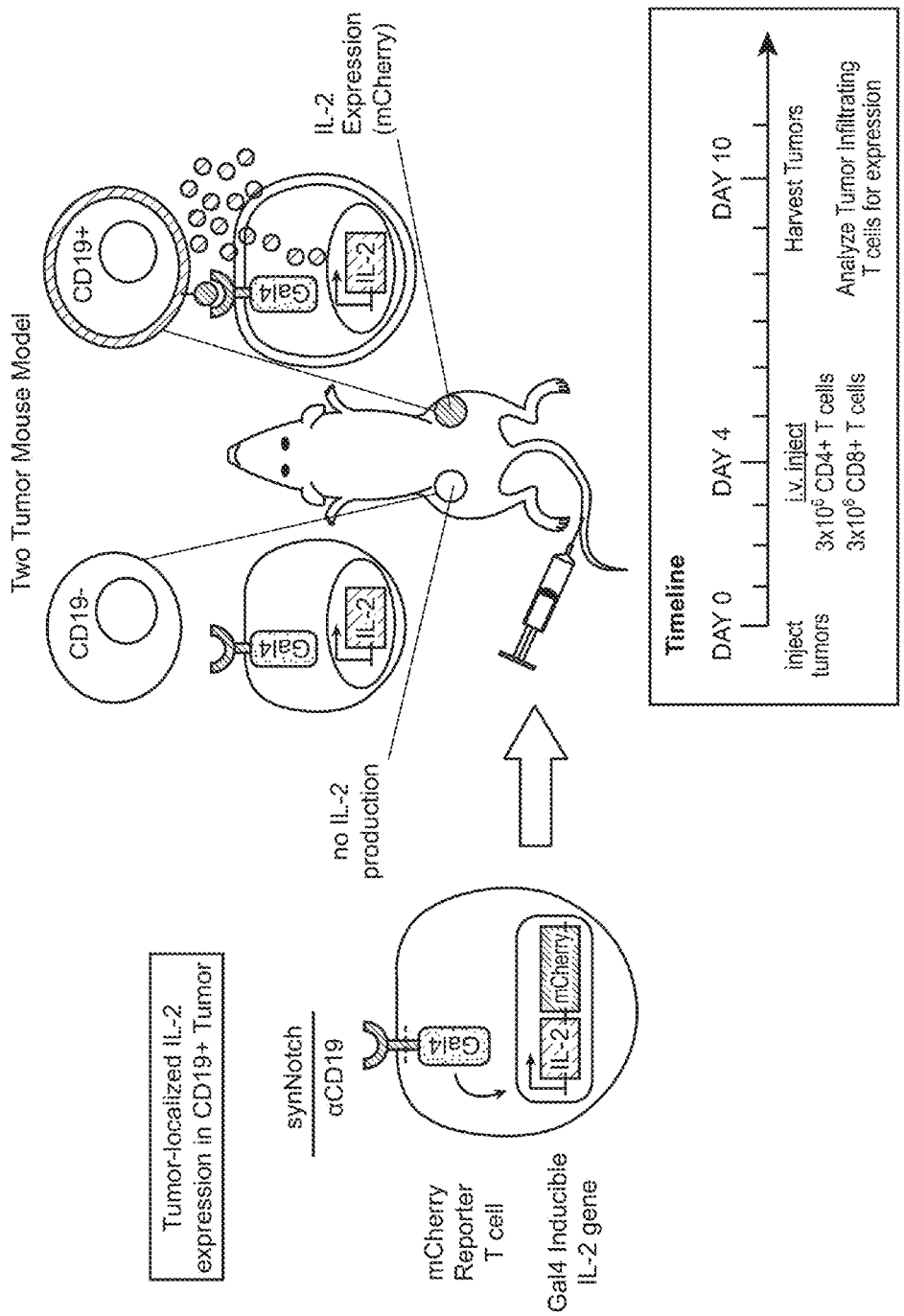
FIGS. 53A-53C demonstrate in vivo local expression of cytokines at solid tumors via a synNotch receptor engineered T cell.
Figure 53B:
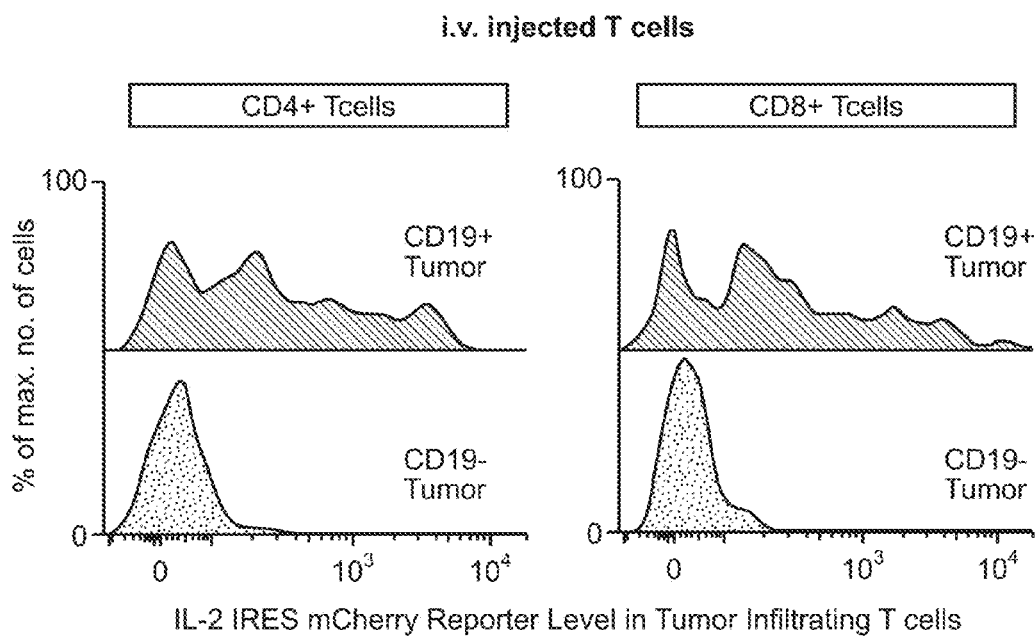
Figure 53C:
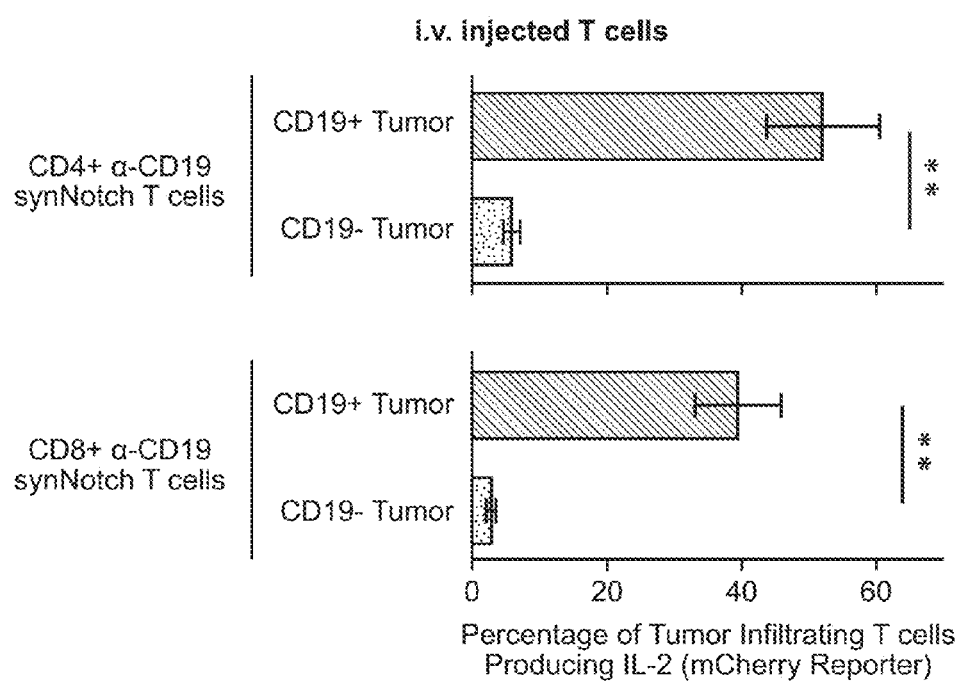
Figure 59D:
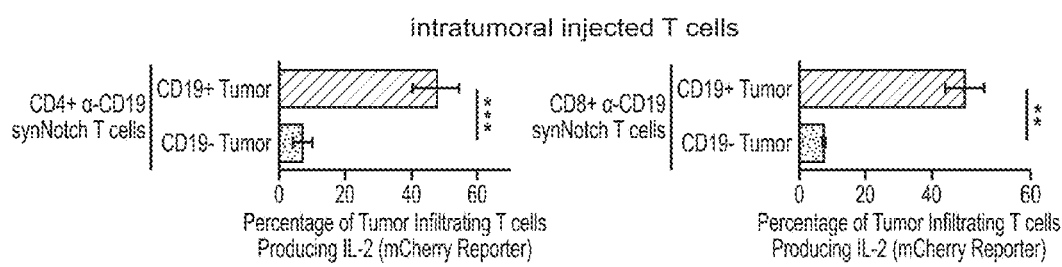
Figure 59E:
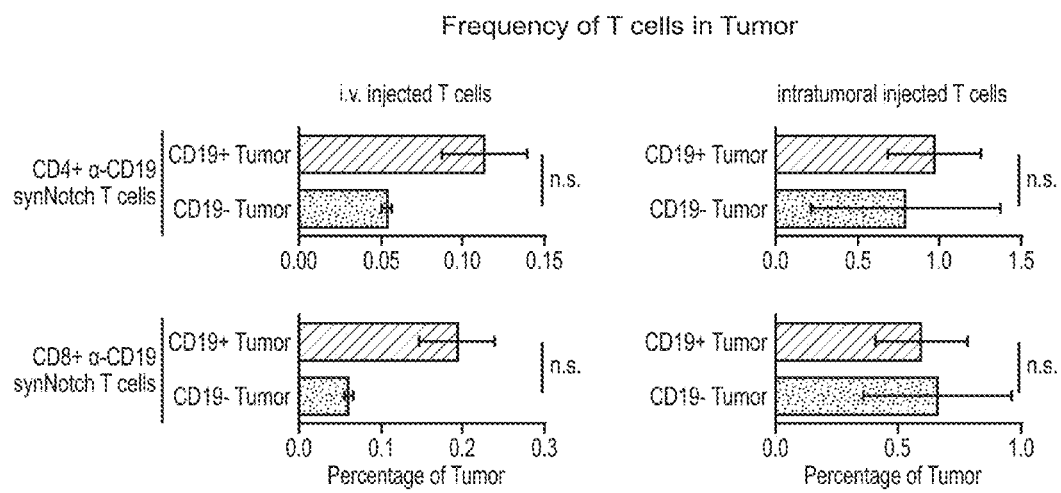

In Vivo Expression of Cytokine in Solid Tumor Via synNotch Receptor Engineered T Cells Since synNotch receptors can precisely regulate a spectrum of T cell responses in vitro, whether the receptors could selectively target primary human T cells in vivo to solid tumors and induce the delivery of a custom payload such as the cytokine IL-2 was investigated. For these experiments, a bilateral K562 xenograft solid tumor model was established in immunocompromised NOD scid gamma (NSG) mice where a non-target CD19− tumor and a target CD19+ tumor were implanted subcutaneously in the left flank and right flank, respectively (FIG. 53A). The tumors were allowed to establish for four days and then CD4+ and CD8+ T cells engineered with the α-CD19 synNotch receptor and response elements in control of IL-2 expression and an IRES mCherry reporter were intravenously (i.v.) injected (FIG. 59A). After six days the tumors were harvested and the tumor infiltrating T cells were analyzed for expression of the IL-2 IRES mCherry reporter (FIG. 53A-53C). Only the tumor localized T cells expressed the mCherry reporter for IL-2 expression in the target CD19 tumor, and the reporter level was similar to what was observed for the same T cells when stimulated in vitro (FIGS. 53A-53C and FIGS. 59B and 59C). While the frequency of T cells was not high in the tumor (1 in 1000 cells for CD4+ and 1 in 500 for CD8+ T cells), the activity of the T cells was highly specific to the target tumor (FIGS. 53B and 53C and FIG. 59D). In addition to i.v. injection of synNotch→IL-2 T cells, the T cells were also directly injected into non-target and target tumors. The tumors were then harvested and analyzed via flow cytometry two days after injection and also showed selective expression of the IL-2 reporter in the target tumor at similar levels to matched in vitro stimulated T cells (FIG. 59E). While the ability of synNotch T cells to infiltrate these tumors could still be improved, these data clearly show that synNotch receptors can target T cells to primary tumors and selectively induce production of a therapeutic agent in a local manner Thus synNotch engineered T cells could prove effective for delivery of a wide-range of genetically encodable therapeutics that could benefit from local delivery both to enhance effectiveness and reduce toxicity of systemic administration.

Figure 48A:
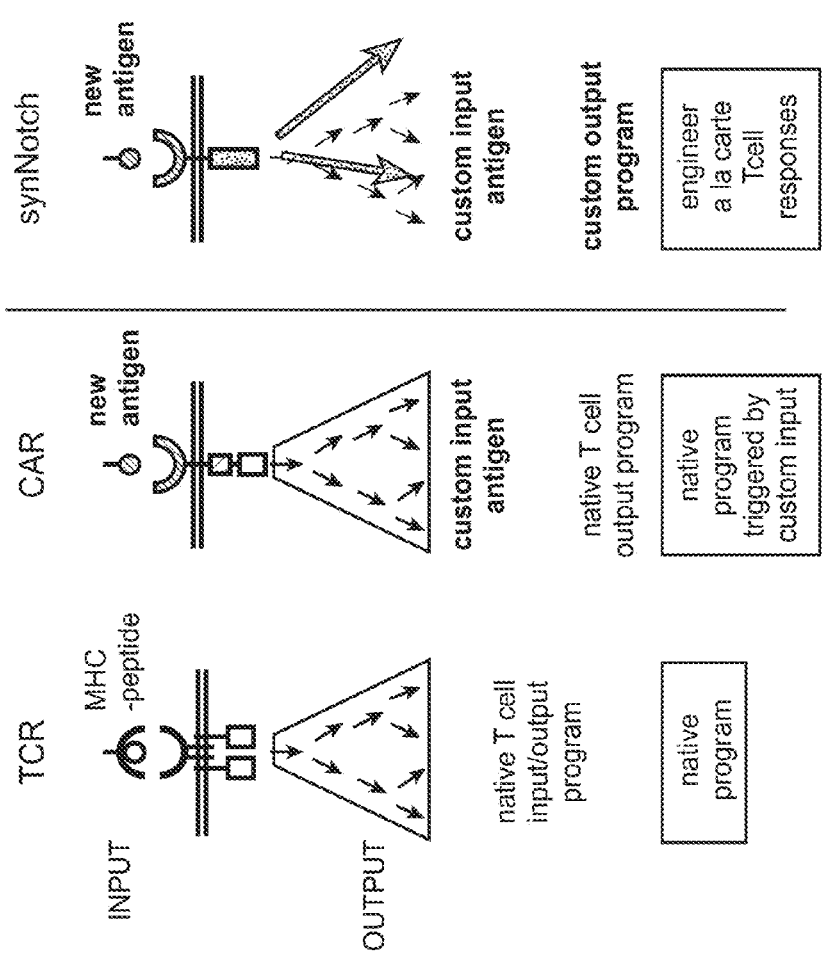
Figure 48C:
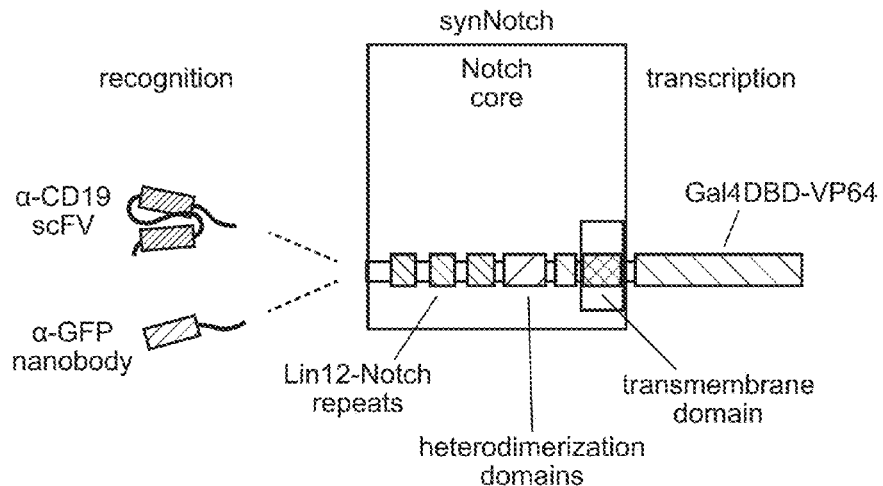

FIG. 48. The Potential to Engineer Customized Therapeutic T Cell Responses Using synNotch Receptors.

(A) TCRs and CARs activate kinase-based signaling cascades that drive the native T cell activation program providing little control over reshaping the T cell response. synNotch receptors recognize cell-surface antigens (e.g. disease related antigens) and directly regulate custom transcriptional programs with more precise control over the T cell response. Thus, synNotch receptors could be used to engineer a la carte responses. (B) synNotch receptors may have a custom ligand binding domain (e.g. scFv or nanobody) that detects a cell-surface antigen of interest, the core regulatory region of Notch, and cytoplasmic domain containing an orthogonal transcription factor (e.g. Gal4 VP64). The corresponding response elements for the orthogonal transcription factor controlling custom transcriptional program may be engineered into the T cell along with the receptor. (C) synNotch receptors with scFvs directed towards the cancer-related antigens CD19 and nanobodies to the orthogonal antigen GFP were engineered and demonstrate the versatility of the synNotch receptor platform.

FIG. 49. synNotch Receptors can Drive Antigen-Induced Transcription in CD4+ and CD8+ Human Primary T Lymphocytes.

(A) CD4+ AND CD8+ primary human T cells were engineered with the α-CD19 synNotch Gal4VP64 receptor and 5× Gal4 response elements controlling the expression of a BFP reporter. (B) Histograms showing selective induction of the BFP reporter in α-CD19 synNotch receptor receiver T cells in response to stimulation with sender cells with CD19− or CD19+ K562s or Daudi cancer cells (CD19+) after 24 hours of co-culture (representative of ≥3 experiments). (C) Percentages of α-CD19 synNotch T cells that upregulate the BFP reporter after 24 hours of stimulation with sender cells calculated from replicate data shown in panel B (n≥3 for all conditions, error bars=SEM). (D) CD4+ AND CD8+ primary human T cells were engineered with α-GFP synNotch Gal4VP64 receptor affinity variants and BFP reporter as in panel A. (E) Histograms showing selective induction of the BFP reporter in α-GFP synNotch receptor receiver T cells in response to surface GFP− or GFP+ K562 sender cells after 24 hours of co-culture (representative of ≥3 experiments, error bars=SEM). (F) Percentages of α-GFP synNotch T cells that upregulate the BFP reporter after 24 hours of stimulation with sender cells calculated from replicate data shown in panels H (n≥3 for all conditions, error bars=SEM).

FIG. 55. Supplemental Data Related to FIGS. 49A-49F.

(A) Two dimensional dot plots of CD4+ (left plot) and CD8+ (right plot) primary human T cells transduced with the α-CD19 synNotch Gal4VP64 receptor (myc tagged) and 5×Gal4 response elements controlling expression of BFP. The response element vector also contains a PGK promoter that drives constitutive expression of mCherry to identify the T cells with the inserted response elements. All BFP reporter expression analysis was performed on T cells that had both the synNotch receptor and the corresponding 5×Gal4 response elements controlling BFP expression (population outlined in upper right box). (B) Histograms showing selective induction of the BFP reporter in synNotch receptor receiver T cells in response to CD19+ K562s or Daudi Tumor cells compared to CD19− K562 control cells after 24 hours of co-culture (representative of ≥3 experiments). (C) Histograms showing CD19 levels on K562s and Daudi tumor cells. Daudi tumors naturally express CD19 and K562s ectopically express CD19 at similar levels. (D) Two dimensional dot plots similar to FIG. 55A for α-GFP nanobody synNotch Gal4VP64 receptor expressing CD4 (top row) and CD8 (bottom row) primary human T cells. Each column is for a particular α-GFP nanobody affinity variant (LaG17, LaG16-2). All BFP reporter expression analysis was performed on T cells in the upper right outlined gate as in FIG. 55A. (E) Histograms showing selective induction of the BFP reporter in synNotch receptor receiver T cells in response to surface GFP+ K562 cancer cells compared to surface GFP− K562s after 24 hours of co-culture (representative of ≥3 experiments). (F) Histograms showing total GFP level in K562 cancer cells expressing surface GFP compared to K562 GFP-controls.

FIG. 50. synNotch Receptors can Drive Antigen-Induced Custom Cytokine Programs.

(A) CAR activation drives T cells to produce a diverse set of cytokines. (B) A scatter plot showing the level (pg/mL) of 25 cytokines (see FIG. 50C for list of cytokines) produced by primary human α-CD19 CAR CD4+ T cells activated with target CD19+ K562 cells (y-axis) or negative control CD19− K562s (x-axis) after 24 hours of stimulation (n=3, error bars=SEM). (C) The level of 25 cytokines produced by CD4+ α-CD19 CAR T cells stimulated by target CD19+ K562s (n=3, error bars=SEM). (D) CD4+ T cells were engineered with the α-CD19 synNotch Gal4VP64 receptor and the corresponding response elements controlling the expression of either IL-2 or IL-10. The cells were co-cultured with target CD19+ K562s or CD19− non-target K562s. (E) Scatterplots as in panel B showing the production of a single cytokine in response to CD19+ K562 stimulation (n=3, error bars=SEM). (F) The level of cytokines produced by α-CD19 synNotch T cells driving IL-2 or IL-10 production in response to CD19+ K562 cells. Only the single cytokine (IL-2 or IL-10) is produced above background levels (n=3, error bars=SEM).

FIG. 56. Supplemental Data Related to FIGS. 50A-50F.

(A) CD4+ human primary T cells were engineered with the α-CD19 synNotch Gal4VP64 receptor and the associated 5×Gal4 response elements in control of IL-2 production. (B) Two dimensional dot plot (left panel) of CD4 primary human T cells transduced with the α-CD19 synNotch Gal4VP64 receptor and 5×Gal4 response elements controlling expression IL-2 expression IRES mCherry. The response element vector also contains a PGK promoter that drives constitutive expression of BFP to identify the T cells with the inserted response elements. T cells that had both the synNotch receptor and the corresponding 5×Gal4 response elements controlling IL-2 IRES mCherry expression were sorted and used for all corresponding assays in FIGS. 50 and 56. (upper right box). The left panel shows no basal induction of the IL-2 IRES mCherry reporter in dual positive T cells compared to untransduced T cells. (C) Dot plots of intracellular cytokine stains for IL-2 are shown for unstimulated CD4+ and CD8+ T cells, unstimulated α-CD19 synNotch Gal4VP64 T cells controlling IL-2 production, and positive control T cells stimulated with PMA/ionomycin for 6 hours. (D) The basal and stimulated IL-2 levels are given for supernatants harvested from untransduced CD4+ T cells, α-CD19 4-1BBζ CAR T cells, and α-CD19 synNotch Gal4VP64 T cells controlling IL-2 production (n=4). (E) CD69 levels (left column) and IL-2 IRES mCherry reporter levels in control CD4+ T cells stimulated with α-CD3/CD28 dynabeads and α-CD19 synNotch Gal4VP64 T cells controlling IL-2 production stimulated with CD19− or CD19+ K562s. CD69 is not upregulated on synNotch T cells upon stimulation with cognate antigen. (F) CD4+ human primary T cells were engineered with the α-CD19 synNotch Gal4VP64 receptor and the associated 5×Gal4 response elements in control of IL-10 production. (G) Equivalent data to panel B for CD4+ primary human T cells transduced with the α-CD19 synNotch Gal4VP64 receptor and 5×Gal4 response elements controlling expression of IL-10 IRES mCherry expression. (H) Equivalent data to panel D for CD4+ primary human T cells transduced with the α-CD19 synNotch Gal4VP64 receptor and 5×Gal4 response elements controlling expression IL-10 IRES mCherry expression. (I) Equivalent data to FIG. 56E for CD4 primary human T cells transduced with the α-CD19 synNotch Gal4VP64 receptor and 5×Gal4 response elements controlling expression IL-10 IRES mCherry expression.

FIG. 51. SynNotch Receptors can Drive Antigen-Dependent Skewing of T Cell Differentiation to the Anti-Tumor $T_{h1}$ Fate.

(A) Natural T cell Differentiation: When CD4+ T cells are activated through engagement of pathogen-derived peptides presented by MHC molecules on antigen-presenting cells they differentiate into particular T cell subtypes depending on the infection. $T_{h1}$ and $T_{h2}$ are canonical CD4+ T cell fates that drive different immune responses. $T_{h1}$ cells express the transcription factor Tbet, produce IFNγ, and aid in cellular immunity and tumor clearance. $T_{h2}$ cells produce IL-4, an important cytokine for stimulation of antibody production by B cells. (B) SynNotch Driven T cell Differentiation: CD4+ α-CD19 synNotch T cells were engineered to regulate the expression Tbet and thus $T_{h1}$ fate choice by T cells. The synNotch T cells were co-cultured with target CD19+ or non-target CD19− K562 cells for 11 days to determine if synNotch driven Tbet expression could skew CD4+ T cells to $T_{h1}$ fate in a CD19-dependent manner (C) Histograms showing the selective expression of Tbet T2A EGFP after 24 hours of CD4+ α-CD19 synNotch T cells with CD19+ K562s (representative of at least 3 experiments). (D) Two dimensional dot plots of intracellular stained CD4+ α-CD19 synNotch Gal4VP64 T cells for Tbet and IFNγ after 11 days of culture with either CD19+ or CD19− K562s. T cells were stimulated with PMA/Ionomycin for 4 hrs prior to staining to drive cytokine production (representative of at least 3 experiments). (E) The percentage of IFNγ+ ($T_{h1}$) T cells after 11 days of the indicated treatment (n≥3 for all treatments, error bars=SEM, significance determined by student's t test, n.s. p>0.05).

FIG. 57. Supplemental Data Related to FIGS. 51A-51E.

(A) Quantification of replicate data from FIG. 51C. CD4+ T cells with α-CD19 synNotch Gal4VP64 receptor response elements controlling Tbet T2A GFP expression were co-cultured with CD19+ or CD19− K562s for 24 hrs. The percentage of T cells with Tbet T2A GFP expression is quantified showing Tbet was only upregulated when the T cells were exposed to CD19+ K562s (n=3). (B) Representative dot plot of CD4 T cells stimulated with α-CD3/CD28 dynabeads and intracellularly stained for the $T_{h1}$ cytokine IFNγ after 11 days in culture. The IFNγ positive gate is boxed in red. (C) Representative dot plot similar to panel B for CD4+ T cells cultured for 11 days in $T_{h1}$ differentiation conditions (IL-12+ α-IL-4) (n=4). (D) Representative histograms of CD4 T cells with constitutive overexpression of Tbet T2A mCherry at 48 hours post transduction. (E) Representative dot plot of intracellular stains of CD4+ T cells with constitutive overexpression of Tbet T2A mCherry for Tbet and IFNγ after 11 days of culture (n=6). Dual positive Tbet and IFNγ T cells are boxed in red. (F) Representative microscopy of CD4+ T cells with the α-CD19 synNotch Gal4VP64 receptor response elements controlling Tbet T2A GFP expression (constitutively express mCherry) co-cultured with control CD19− K562s. The synNotch T cells (red cells) do not associate with the cancer cells or upregulate the reporter of Tbet expression (GFP). (G) Representative microscopy as in panel F but the T cells were co-cultured with CD19+ T cells. The synNotch T cells (red cells) form assemblies with CD19+ K562s and upregulate Tbet T2A GFP expression. The activated synNotch T cells are yellow due mCherry and GFP coexpression.

FIG. 52. SynNotch Driven TRAIL Production—Custom T Cell Delivery of Non-Native Therapeutic.

(A) Natural T cell cytotoxicity: CD8+ cytotoxic T cells recognize infected cells via their TCR and directly kill the infected cell by creating pores in the cell with perforin allowing for the delivery of granzymes that initiate programmed cell death. (B) SynNotch Customized Killer T cell: CD4+ T cells were engineered with the α-GFP synNotch that controls the expression of the apoptotic regulator TRAIL in response to surface GFP. (C) Histograms showing the selective expression of surface TRAIL after 24 hours of CD4+ α-GFP synNotch T cells with surface GFP+ K562s. (D) Histograms showing surface GFP+ K562 cell death via uptake of the dead stain SYTOX blue after 24 hr. co-culture with the indicated T cell type (T cell:Target Cell Ratio=1:1). (E) Percentage target cell survival calculated from replicate data shown in panel D (n=4, error bars=SEM).

FIG. 58. Supplemental Data Related to FIGS. 52A-52E.

(A) Rested CD4+ and CD8+ T cells were restimulated for 24 hrs with α-CD3/CD28 dynabeads and stained for cell surface TRAIL. Neither T cell subset acutely upregulates TRAIL expression. (B) Cancer cells vary in their sensitivity to recombinant TRAIL-mediated apoptosis. HCT116 colon cancers have the death receptors bound by TRAIL and are sensitive to low level TRAIL treatment. K562s express the death receptors for TRAIL but are insensitive to TRAIL treatment. (C) Surface GFP− or GFP+ K562s or HCT116 cancer cells were treated with 0 to 200 ng/mL of recombinant TRAIL for 24 hrs and death was monitored via flow cytometry by staining with the dead stain SYTOX blue (n=4). (D) Histogram of K562s stained for the death receptor 4 (DR4) bound by TRAIL. K562s express the receptor their resistance to TRAIL-mediated apoptosis. (E) Representative dot plots of CD4+ T cells transduced with the LaG17 α-GFP nanobody synNotch Gal4VP64 and 5×Gal4 response elements controlling expression of leucine zipper TRAIL (LZ-TRAIL left panel) or full-length surface TRAIL (right panel). The level of the mCherry reporter of TRAIL expression is shown below for the dual positive T cells and control untransduced T cells. (F) CD4+ T cells transduced with the LaG17 α-GFP nanobody synNotch Gal4VP64 and 5×Gal4 response elements controlling expression LZ-TRAIL were co-cultured with surface GFP− or GFP+ K562s for 24 hrs to determine if LZ-TRAIL is secreted only in response to GFP+ K562s. (G) Histograms showing the level of mCherry reporter levels of TRAIL production in sorted synNotch CD4 LZ-TRAIL T cells shown in FIG. 58E were co-cultured with surface GFP= or GFP+ K562s. The reporter was exclusively activated in response to surface GFP+ K562s. (H) TRAIL ELISA of supernatant from sorted synNotch CD4 LZ-TRAIL T cells co-cultured with either surface GFP− or GFP+ K562s for 24 hrs (n=2).

FIG. 53. In Vivo Local Expression of Cytokines at Solid Tumors Via synNotch Receptor Engineered T Cell.

(A) NSG mice were subcutaneously injected with CD19− non-target K562s and target CD19+ in the left and right flank, respectively. α-CD19 synNotch T cells in control of IL-2 iRES mCherry expression were injected into the mice after tumors were established and tumors were harvested at the indicated timepoint to determine whether the synNotch T cells had infiltrated the tumor and expression of IL-2 and mCherry reporter was induced. (B) Histograms of IL-2 IRES mCherry reporter levels in tumor infiltrated CD4+ and CD8+ synNotch T cells injected i.v., showing selective expression of the mCherry reporter in target CD19+ tumors (data representative of 3 replicate mice). (C) Quantification of the percentage of tumor infiltrated T cells that induced expression of the mCherry reporter of IL-2 expression from replicate data shown in panel B (n=3, significance determined by student's t test **p<0.01).

FIG. 59. Supplemental Data Related to FIGS. 53A-53C.

(A) Two dimensional dot plots of CD4+ (left plot) and CD8+ (right plot) primary human T cells transduced with the α-CD19 synNotch Gal4VP64 receptor (myc tagged) and 5×Gal4 response elements controlling expression of IL-2 IRES mCherry. The response element vector also contains a PGK promoter that drives constitutive expression of BFP to identify the T cells with the inserted response elements. T cells in the upper right shaded box were sorted and used for all in vivo and in vitro experiments. (B) Representative histograms of CD4+ and CD8+ synNotch T cells in control of IL-2 expression stimulated in vitro with CD19– or CD19+ K562s. IL-2 IRES mCherry expression occurred only in the presence of CD19. (C) Quantification of the percentage CD4+ and CD8+ T cells that induced expression of the mCherry reporter of IL-2 expression from replicate data shown in FIG. 59B (n=3, significance determined by student's t test *p<0.001 and **p<0.0001). (D) Histograms of IL-2 IRES mCherry reporter levels in tumor infiltrated CD4+ and CD8+ synNotch T cells injected intratumorally, showing selective expression of the mCherry reporter in target CD19+ tumors (data representative of 3 replicate mice). Protocol for intratumoral injection experiments is shown. Results are similar to what is observed for i.v. injected T cells and in vitro stimulated T cells. (E) The percentage of CD4+ and CD8+ T cells that have infiltrated the CD19– and CD19+ tumor after i.v. and intratumorally injection (n=3, error bars=SEM, significance determined student's t-test, n.s. p>0.05).

Figure 54A:
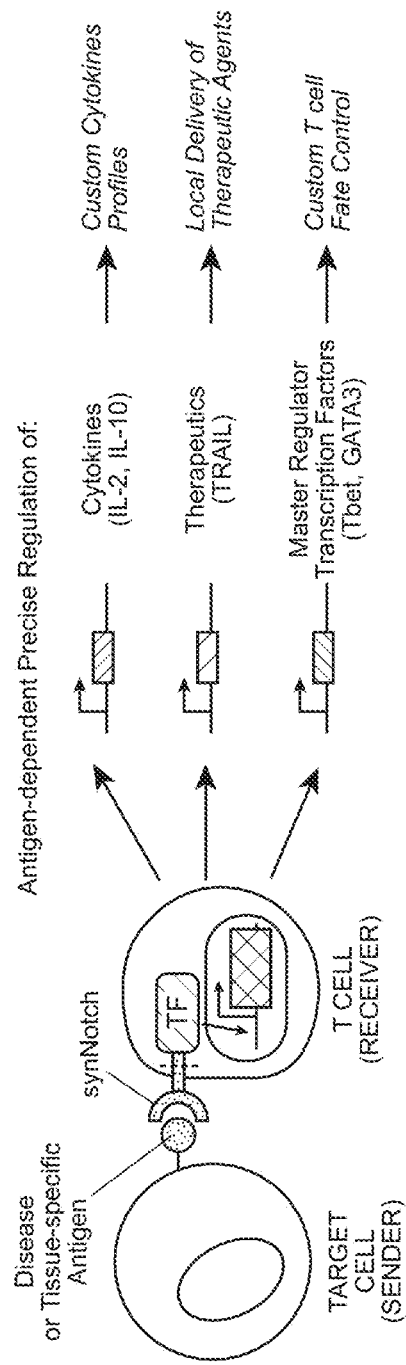
FIGS. 54A-54B demonstrate that synNotch receptors are versatile regulators that allow T cells to monitor and selectively modulate their microenvironment.
Figure 54B:
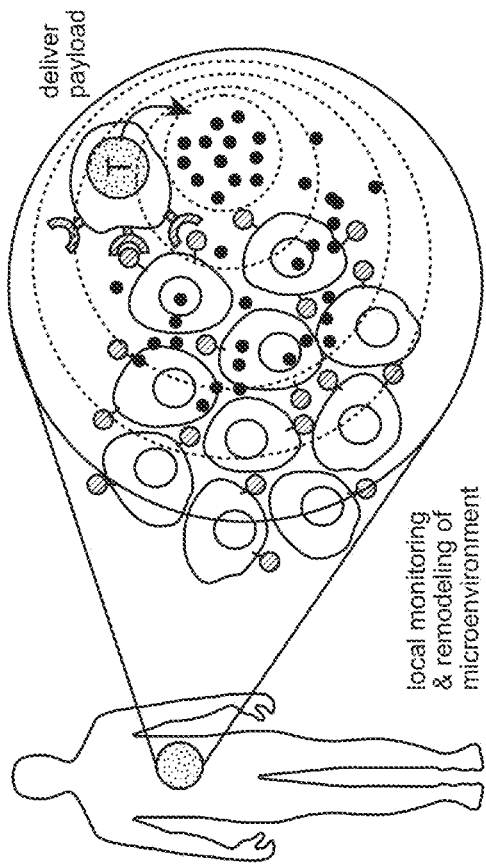

FIG. 54. SynNotch Receptors are Versatile Regulators that Allow T Cells to Monitor and Selectively Modulate their Microenvironment.

(A) synNotch receptors are versatile regulators of T cell response: synNotch receptors can drive diverse behaviors in primary human T cells. synNotch receptors can drive custom cytokine production profiles, effectively deliver non-native therapeutics, and control T cell differentiation, all in an antigen-dependent and T cell activation independent manner (B) synNotch are sufficient to target T cells in vivo to locally produce a therapeutic payload.

Example 5: Precision Tumor Recognition by Therapeutic T Cells that Integrate Synthetic Notch and Chimeric Antigen Receptor Signaling to Detect Combinatorial Antigen Signatures Material and Methods The following materials and methods apply to the results described in Example 5 unless otherwise indicated.

synNotch Receptor and Response Element Construct Design synNotch receptors were built by fusing the CD19 scFv, LaG17 (lower affinity), or LaG16_2 (high affinity) nanobody to the mouse Notch1 (NM_008714) minimal regulatory region (Ile1427 to Arg1752) and Gal4VP64 or TetR VP64 (tTa). All synNotch receptors contain an n-terminal CD8a signal peptide (MALPVTALLLPLALLLHAARP (SEQ ID NO:129)) for membrane targeting and a myc-tag (EQKLISEEDL (SEQ ID NO:75)) for easy determination of surface expression with α-myc A647 (cell-signaling #2233). The receptors were cloned into a modified pHR'SIN:CSW vector containing a PGK promoter for all primary T cell experiments. The pHR'SIN:CSW vector was also modified to make the response element plasmids. Five copies of the Gal4 DNA binding domain target sequence (GGAGCACTGTC-CTCCGAACG (SEQ ID NO:130)) were cloned 5' to a minimal CMV promoter. Also included in this the response element plasmids is a PGK promoter that constitutively drives mCherry expression so transduced T cells can be easily distinguished. For all inducible CAR vectors, the CARs were tagged c-terminally with GFP and were cloned via a BamHI site in the multiple cloning site 3' to the Gal4 response elements. All constructs were cloned via In-Fusion cloning (Clontech #5T0345)).

Primary Human T Cell Isolation and Culture

Primary CD4+ and CD8+ T cells were isolated from anonymous donor blood after apheresis by negative selection (STEMCELL Technologies #15062 & 15063). Blood was obtained from Blood Centers of the Pacific (San Francisco, Calif.) as approved by the University Institutional Review Board. T cells were cryopreserved in RPMI-1640 (UCSF cell culture core) with 20% human AB serum (Valley Biomedical Inc., #HP1022) and 10% DMSO. After thawing, T cells were cultured in human T cell medium consisting of X-VIVO 15 (Lonza #04-418Q), 5% Human AB serum and 10 mM neutralized N-acetyl L-Cysteine (Sigma-Aldrich #A9165) supplemented with 30 units/mL IL-2 (NCI BRB Preclinical Repository) for all experiments.

Lentiviral Transduction of Human T Cells

Pantropic VSV-G pseudotyped lentivirus was produced via transfection of Lenti-X 293T cells (Clonetech #11131D) with a pHR'SIN:CSW transgene expression vector and the viral packaging plasmids pCMVdR8.91 and pMD2.G using Fugene HD (Promega #E2312). Primary T cells were thawed the same day, and after 24 hours in culture, were stimulated with Dynabeads Human T-Activator CD3/CD28 (Life Technologies #11131D) at a 1:3 cell:bead ratio. At 48 hours, viral supernatant was harvested and the primary T cells were exposed to the virus for 24 hours. At day 4 post T cell stimulation, Dynabeads were removed and the T cells expanded until day 9 when they were rested and could be used in assays. T cells were sorted for assays with a FACs ARIA II.

Cancer Cell Lines

The cancer cell lines used were K562 myelogenous leukemia cells (ATCC #CCL-243), Daudi B cell lymphoblasts (ATCC #CCL-213), and HCT115 colon cancer cells (ATCC #CCL-247). K562s were lentivirally transduced to stably express human CD19 at equivalent levels as Daudi tumors. CD19 levels were determined by staining the cells with α-CD19 APC (Biolegend #302212). K562s were also transduced to stably express surface GFP (GFP fused to the PDGF transmembrane domain). All cell lines were sorted for expression of the transgenes.

In Vitro Stimulation of synNotch T Cells

For all in vitro synNotch T cell stimulations, 2×10$^5$ T cells were co-cultured with sender cells at a 1:1 ratio. After mixing the T cells and sender cells in round bottom 96-well tissue culture plates, the cells were centrifuged for 1 min at 400×g to force interaction of the cells and the cultures were analyzed at 24 hours for markers of activation (e.g. CD69) for CD4+ T cells and specific lysis of target tumor cells for CD8+ T cells with a BD LSR II. All flow cytometry analysis was performed in FlowJo software (TreeStar).

Luminex MAGPIX Cytokine Quantification

Primary CD4+ T cells expressing the α-CD19 synNotch Gal4VP64 receptor and 5x Gal4 response elements controlling the a CAR were stimulated as described above with the indicated target cancer cell line. The supernatant was collected at 24 hours and analyzed with a Luminex MAGPIX (Luminex Corp.) Human Cytokine Magentic 25-plex Panel (Invitrogen ref#LHC0009M) according to the manufacturer's protocol. All cytokine levels were calculated based on standard curves with xPONENT software (Luminex Corp.).

IL-2 ELISA and CD69 Staining

CD4+ synNotch AND Gate T cells were stimulated with the indicated cancer cell line as described above for 24 hours and supernatant was harvested. IL-2 levels in the supernatant were determined via IL-2 ELISA (eBiosciences #BMS2221HS). The T cells were also collected and stained with α-CD69 APC (Biolegend #310910) to determine if they were activated.

Assessment of synNotch AND Gate T Cell Cytotoxicity

CD8+ synNotch AND Gate T cells were stimulated for 24 hours as described above with target cells expressing the indicated antigens. The level of specific lysis of target cancer cells was determined by comparing the fraction of target cells alive in the culture compared to treatment with untransduced T cell controls. Cell death was monitored by uptake of the live/dead stain SYTOX Blue and shifting of the target cells out of the normal SSC/FSC region normally populated by the target cells (Thermo Scientific #S34857).

In Vitro Quantification of Luciferase Reporter Activity in synNotch T Cells

Sorted CD4+ and CD8+ primary human T cells engineered to express the α-GFP nanobody (LaG17) synNotch Gal4VP64 receptor and the corresponding response elements controlling α-CD19 4-1BBζ CAR IRES effluc expression were stimulated with GFP+ or GFP-K562 cells for 24 hours ($2\times10^5$ T cells and $2\times10^5$ K562s). Production of effluc was assessed with the ONE-glo Luciferase Assay System (Promega #E6110). Bioluminescence was measure with a FlexStation 3 (Molecular Devices).

In Vivo Luciferase Imaging of synNotch T Cells

Animal studies were conducted with the UCSF Preclinical Therapeutics Core under a protocol approved by the UCSF Institutional Animal Care and Use Committee. Ten days prior to T cell injection Daudi tumors and surface GFP Daudi tumors were injected subcutaneously into the left and right of NOD scid gamma (NSG) mice (female, 8-12 weeks old, Jackson Laboratory #005557). Sorted CD4+ and CD8+ primary human T cells engineered to express the α-GFP nanobody (LaG17) synNotch Gal4VP64 receptor and the corresponding response elements controlling α-CD19 4-1BBζ CAR IRES effluc expression were injected at a 1:1 CD4+ to CD8+ T cell ration ($1\times10^6$ of each T cell type) i.v. into the tumor bearing mice 10 days post tumor implantation. Luciferase expression was monitored over 11 days with bioluminescent imaging performed using the IVIS 100 (Xenogen) preclinical imaging system at the indicated time point. Images were acquired 10 min following i.p injection 150 mg/kg of D-luciferin (Gold Technology #LUCK-100). Quantification of integrated bioluminescence intensities were quantified in ImageJ (NIH).

In Vivo Dual Antigen Tumor Targeting by synNotch AND Gate T Cells

NSG mice were implanted with $5\times10^6$ CD19 K562s and GFP/CD19 K562 tumor cells subcutaneously on the left and right flank, respectively. Four days post tumor implantation, $1\times10^6$ primary human CD4+ and CD8+ T cells ($2\times10^6$ total T cells) engineered with the α-GFP synNotch Gal4VP64 receptor and the corresponding response elements regulating α-CD19 4-1BBζ CAR expression or untransduced T cells were injected i.v. into the mice. Tumor size was monitored by the UCSF Preclinical Therapeutics Core staff via caliper over 20 days after T cell injection. For Kaplan-Meier experiments the same protocol was used, but single tumors were injected. Mice were considered dead when the tumor size reached euthanasia criteria (2000 mm$^3$).

Statistical Analysis and Curve Fitting

Statistical significance was determined by Student's t test (two-tailed) unless otherwise noted. All statistical analysis and curve fitting was performed with Prism 6 (Graphpad) and p values are reported (n.s.=p>0.05, *=p≤0.05, =p≤0.01, *=p≤0.001, ****=p≤0.0001). All error bars represent either S.E.M. or S.D.

Results

Figure 60A:
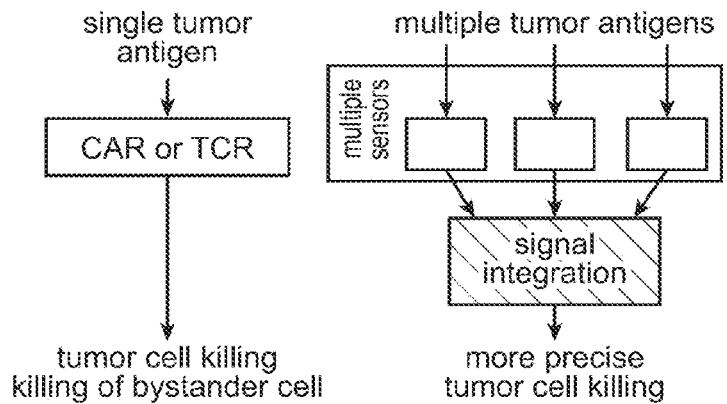
FIGS. 60A-60D provide embodiments of synNotch receptors for combinatorial antigen sensing in T cells.
Figure 60B:
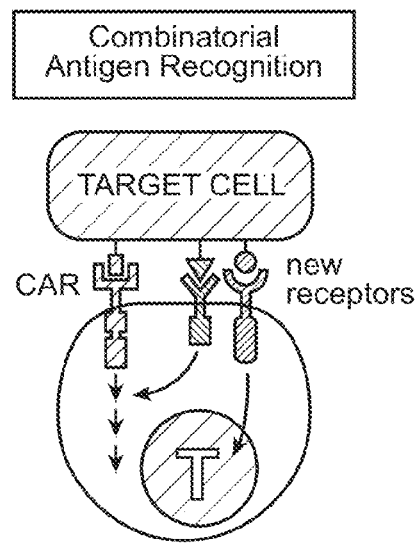
Figure 60C:
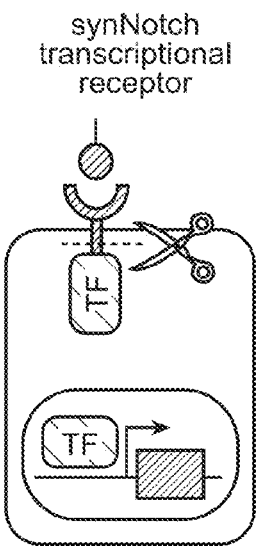
Figure 60D:
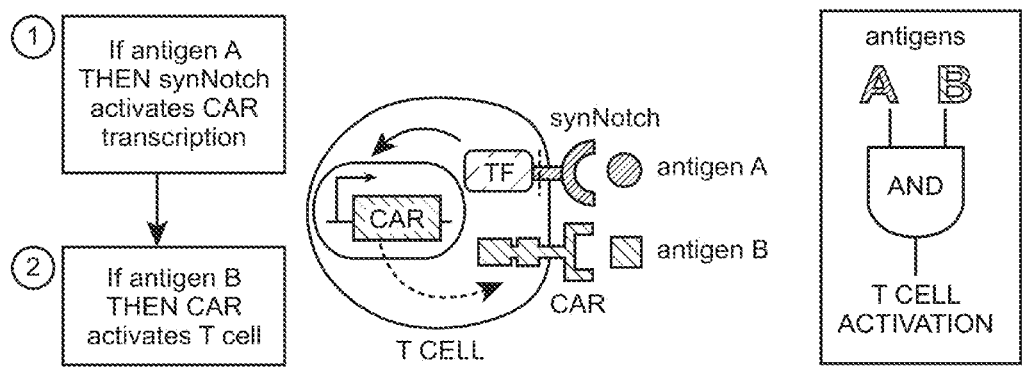

Design of a Two Antigen AND-Gate Circuit: synNotch Receptor Induces CAR Expression The design of a simple two receptor AND gate circuit is outlined in FIG. 60D. A T cell is engineered to basally express a synNotch receptor that recognizes antigen A. In addition, the gene for a CAR that recognizes antigen B would also be inserted into the cell, but it would be under the control of a promoter that requires activation by the synNotch induced transcription factor (synNotch engagement results in receptor cleavage and release of a transcriptional activation domain, see Example 3). Thus, no CAR expression or activity should be present in the cell until the synNotch receptor is activated. This sequential receptor activation circuit should be highly modular in design, since the antigen recognition properties of both receptors can be easily changed by swapping extracellular domains.

Figure 61A:
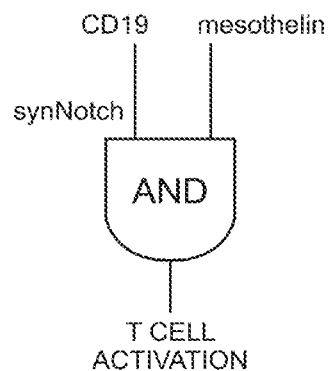
Figure 66A:
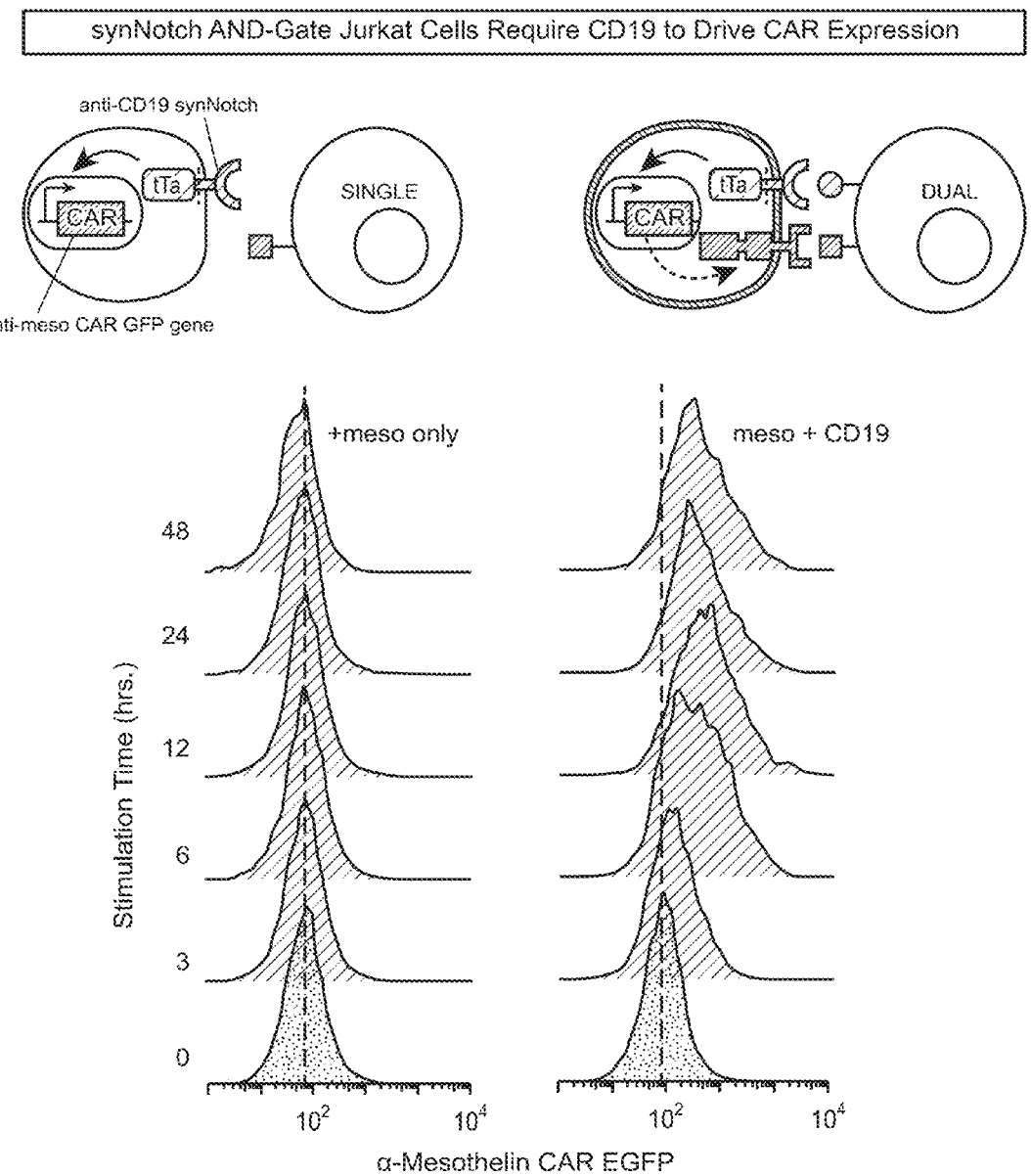

Testing synNotch-Gated CAR Expression in Jurkat T Cells—Combinatorial Antigen Requirement for Jurkat T Cell Activation To test this method of utilizing synNotch receptors to control the expression of CARs, an attempt was made to engineer combinatorial antigen control over the activation of Jurkat T cells. In these experiments two model tumor antigens, CD19 and Mesothelin, were targeted. The Jurkat T cells were engineered with an α-CD19 synNotch receptor bearing an intracellular tetracycline-controlled transactivator (tTa) domain. α-Mesothelin 4-1BBζ CAR gene was inserted, under the control of a promoter with the corresponding tetracycline response elements (TRE) activated by the synNotch receptor (FIGS. 61A and 61B). The engineered Jurkats were co-cultured in vitro with target K562 myelogenous leukemia cells with ectopic expression of CD19, Mesothelin, or both antigens together (FIG. 61A). Since these engineered Jurkat cells only express the α-Mesothelin CAR in response to α-CD19 synNotch stimulation, the T cells should not activate in response to Mesothelin alone. If the T cells are exposed to CD19, the α-Mesothelin CAR is expressed and the T cells are primed for activation (FIGS. 61A and 61B and FIG. 66A). The T cells can then sense Mesothelin and activate.

Figure 66B:
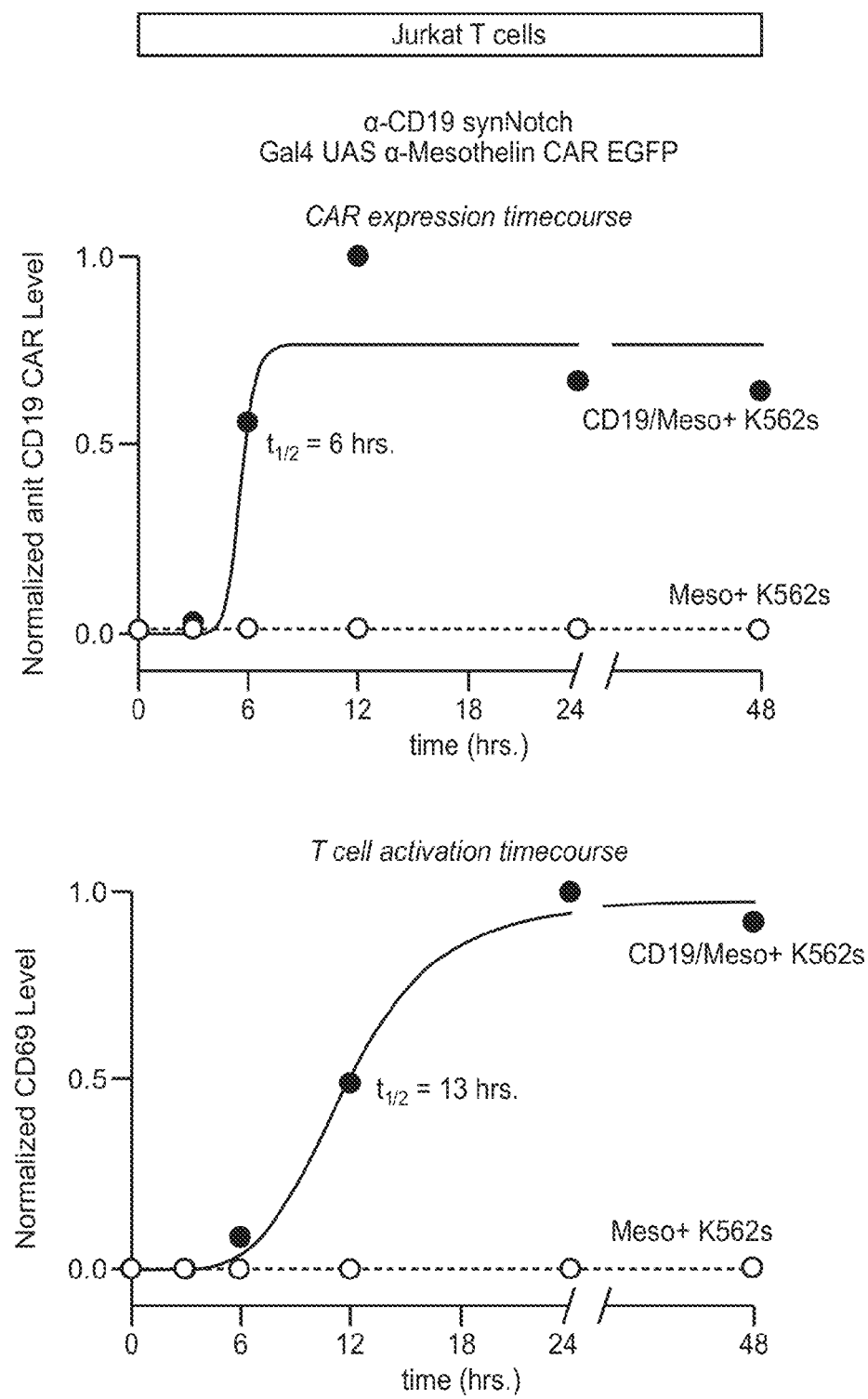

When these cells were tested, activation only by the tumor cells that expressed both CD19 and mesothelin was indeed observed, as measured by the upregulation of the activation marker CD69 and secretion of IL-2 (FIGS. 61C and 61D and FIGS. 66A-66B). Tumor cells expressing either single antigen did not lead to activation. In the case of dual antigen stimulation, Jurkat synNotch AND Gate T cells were seen to be able to upregulate CAR expression in response to tumor cells within 6 hours and reach their peak of activation by 24 hours (FIGS. 66A and 66B). The T cell activation (monitored via CD69) occurs shortly after CAR expression initiates, with an expected additional delay of a few hours (FIG. 66B).

To further characterize the dynamics of synNotch induced CAR expression, the synNotch T cells were exposed to a surrogate of the priming antigen CD19. Since the α-CD19 synNotch receptor has a myc-tag on its extracellular domain, it was found that the receptor could also be activated by exposure of the cells to α-myc antibody coated plates. This activation approach allows for rapid cessation of synNotch activation by removing cells from the plate-bound antigen. After 24 hours of stimulus with α-myc antibody, the T cells were removed and the decay of α-Mesothelin CAR expression was monitored over 24 hours. The T cells completely downregulated CAR expression to unstimulated levels by 24 hours (half-life of expression=8 hours) (FIGS. 66C and 66D).

SynNotch-Gated CAR Expression in Human Primary T Cells—Combinatorial Antigen Control Over T Cell Activation and Tumor Killing Given the success of the synNotch AND gate in Jurkat T cells, it was tested whether the same type of synNotch-driven CAR expression circuit could function in primary T cells to discriminate multiple antigens. It was found that a spectrum of different synNotch Gal4VP64 receptors express well in primary T cells and that the Gal4 response elements have minimal basal activity in primary T cells. This is an ideal scenario for the synNotch driven CAR expression AND gate, because there should be no basal expression of the activating CAR until the T cells sense the synNotch antigen.

As a proof of principal demonstration of this approach, the α-GFP nanobody synNotch Gal4VP64 receptor (recognizes surface expressed GFP) to drive expression of the α-CD19 4-1BBζ CAR (FIG. 62A) was utilized. The rationale for choosing this model setup is that the α-CD19 CAR is a gold standard in the field of immunotherapy and it shows potent tumor clearance in vivo.

Figure 62B:
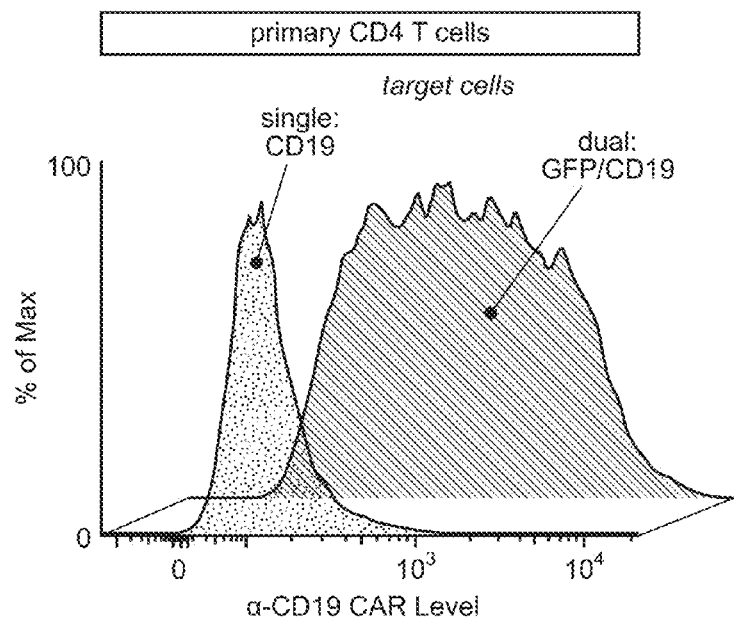
Figure 62C:
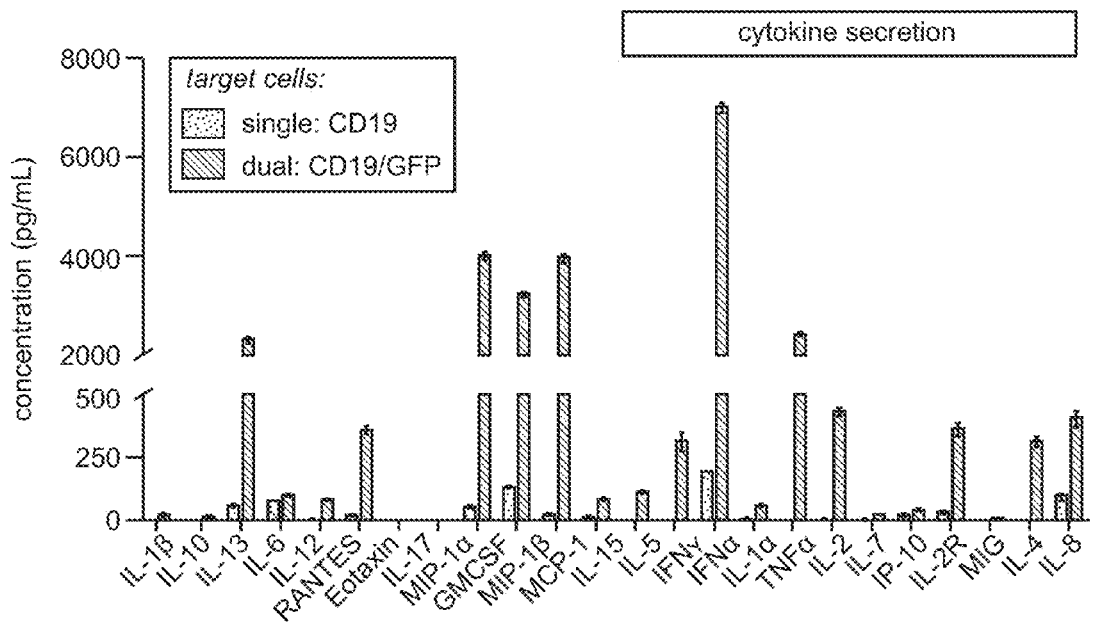

Human primary CD4+ T cells were engineered with the α-GFP nanobody synNotch Gal4VP64 receptor and the corresponding response elements controlling α-CD19 4-1BBζ CAR expression, then exposed to K562 target cells expressing CD19 only, GFP only, or GFP and CD19. The CD4+ T cells only displayed expression of the α-CD19 4-1BBζ CAR when stimulated with cells expressing the synNotch ligand, GFP (FIG. 62B). Moreover, these T cells only showed activation, as assayed by cytokine production, when exposed to target cells expressing both antigens, GFP and CD19, on their surface (FIGS. 62B and 62C).

Figure 62D:
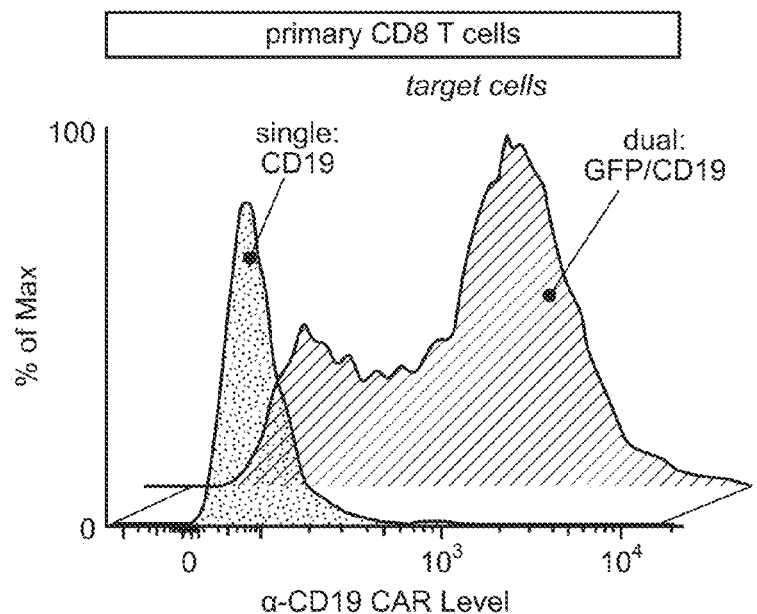
Figure 62E:
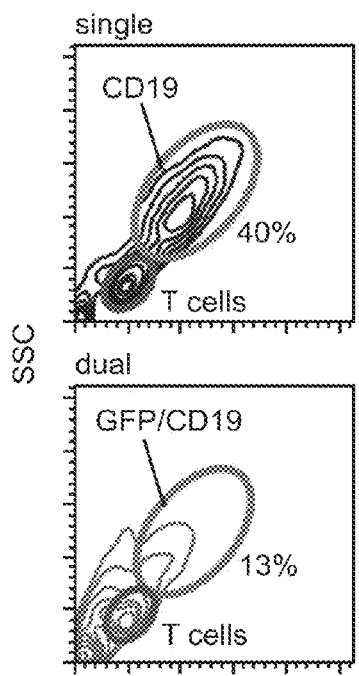
Figure 62F:
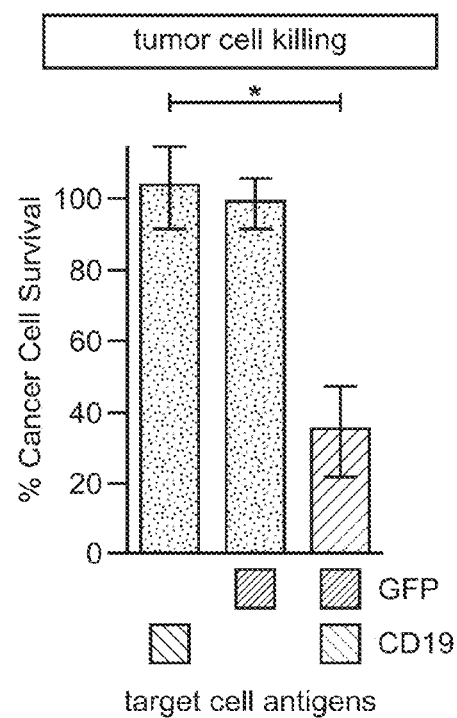

Human primary CD8+ cells containing the same dual receptor circuit also showed AND gate behavior, only killing targets when GFP and CD19 were present on the target cell surface (FIG. 62D-62F). Thus, the synNotch AND gate is functional in the critical cell types required for T cell immunotherapy in humans. To show the versatility and modularity of this approach, three other synNotch/CAR AND gate configurations were tested. All showed combinatorial antigen requirements for CD4+ and CD8+ T cell activation (FIG. 67A-67I).

synNotch Receptors Drive Tumor Localized CAR Expression In Vivo

Figure 63A:
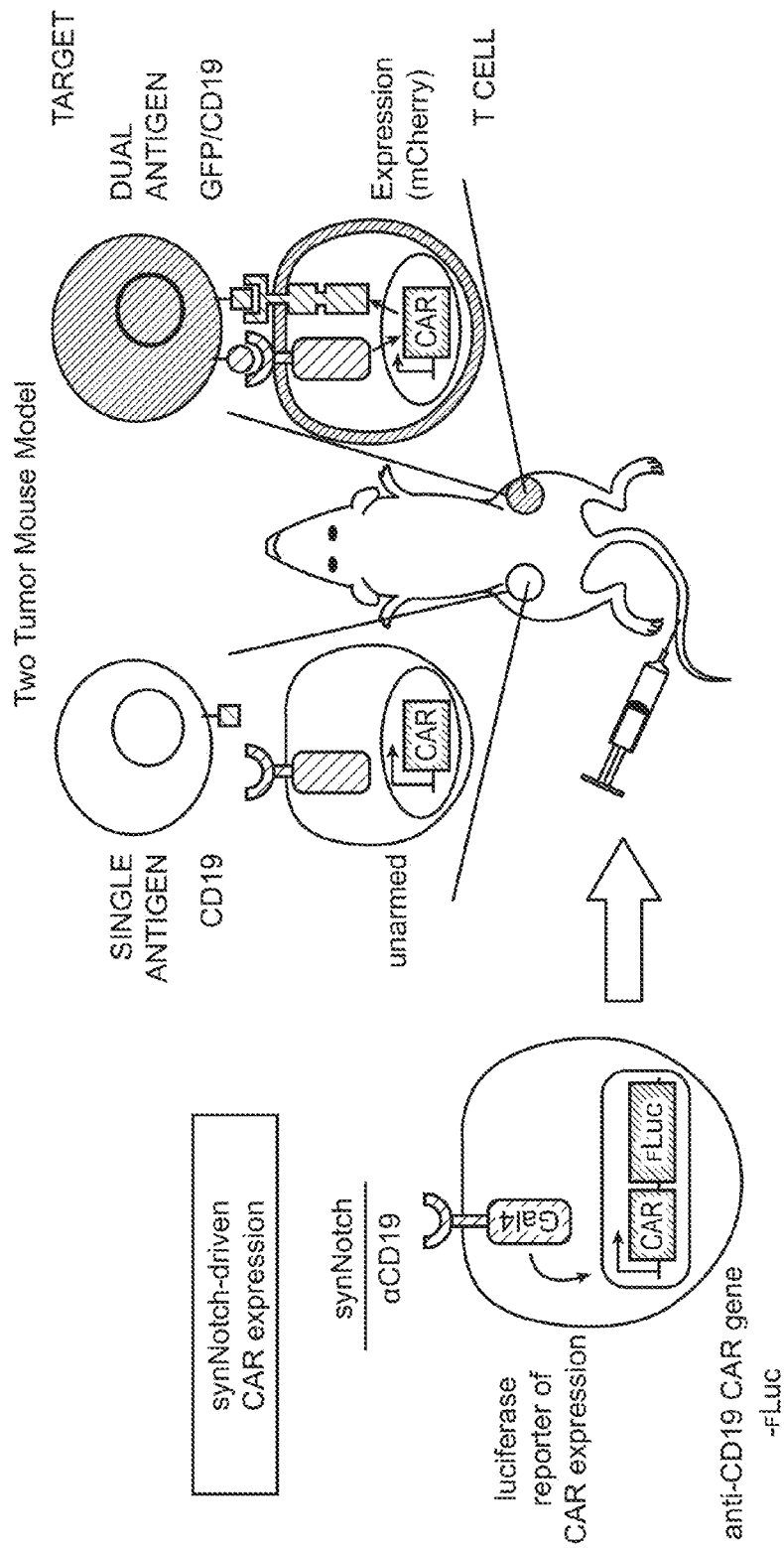
FIGS. 63A-63C show synNotch receptors driving tumor localized CAR expression in vivo.
Figure 63B:
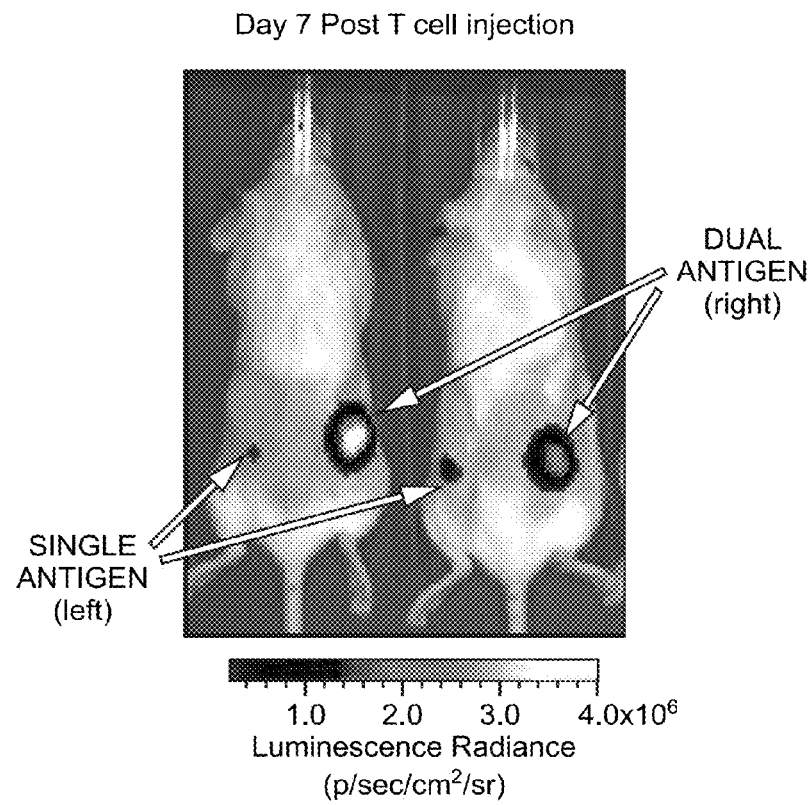
Figure 63C:
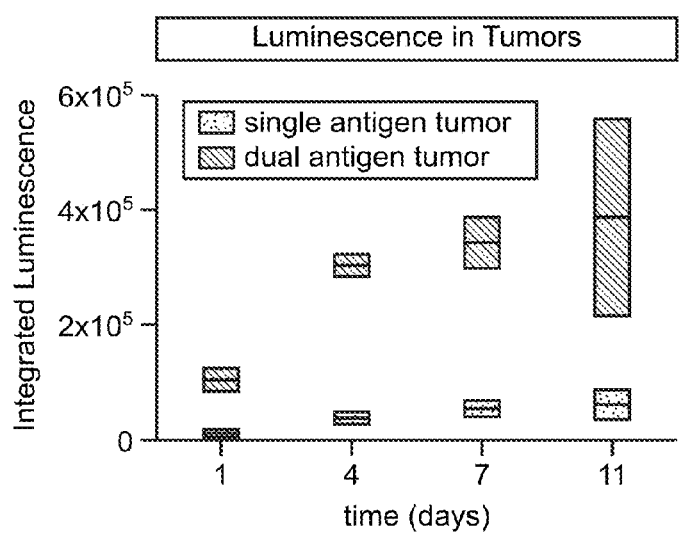
Figure 68A:
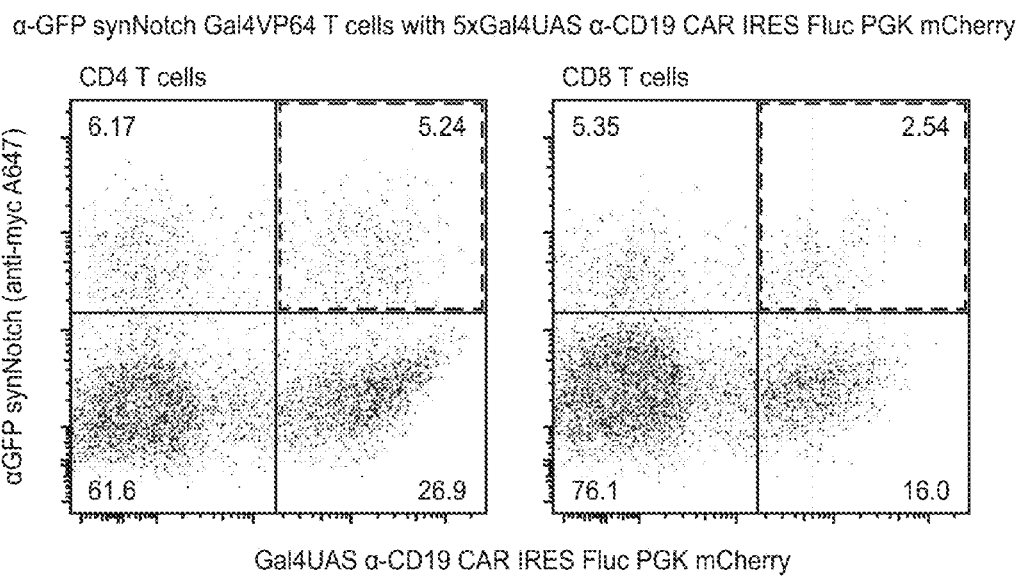
FIGS. 68A-68C provide supplemental data related to FIGS. 63A-63C.
Figure 68B:
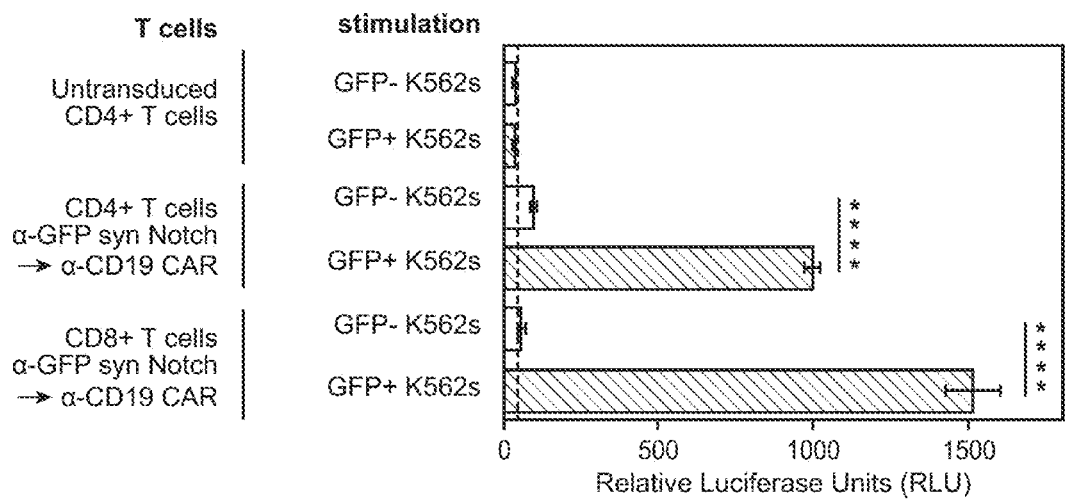
Figure 68C:
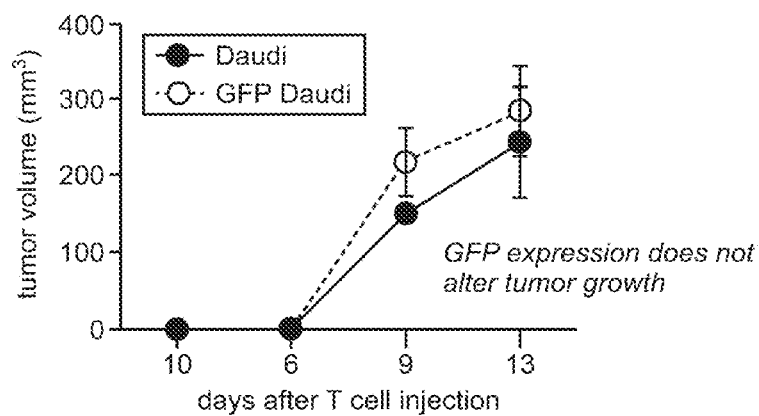

Since synNotch receptors reliably gate CAR expression in primary T cells in vitro, it was tested whether T cells could be targeted to tumors in vivo via synNotch receptors and only express the CAR when in the tumor microenvironment. For this experiment, bilateral xenograft CD19 Daudi B cell lymphoblast tumors were injected into immunocompromised NOD scid IL-2Rγ$^{-/-}$ (NSG) mice. Wild-type Daudi cells (containing no synNotch ligand) were injected subcutaneously in the left flank, while Daudi tumor cells expressing surface GFP were injected in the right flank. After giving the tumors ten days to implant, primary CD4+ and CD8+ human T cells equipped with the α-GFP synNotch Gal4VP64 receptor and the corresponding response elements controlling the expression of the α-CD19 4-1BBζ CAR and an IRES enhanced firefly luciferase (effluc) reporter (FIGS. 68A and 68B) were injected. Luciferase expression was monitored as a reporter for CAR expression over the course of 11 days (FIG. 63A, FIG. 68C). The T cells started to express the CAR selectively in the GFP+ Daudi tumor by day 1 and continually increased local expression of the CAR over the 11 day period in the dual antigen tumor (FIGS. 63B and 63C). The increase in luciferase signal in the target tumor is likely a combination of synNotch-driven CAR expression and expansion of cells in the dual antigen target tumor (FIG. 68B). No increase in luciferase was observed in the control GFP− tumor.

Figure 64B:
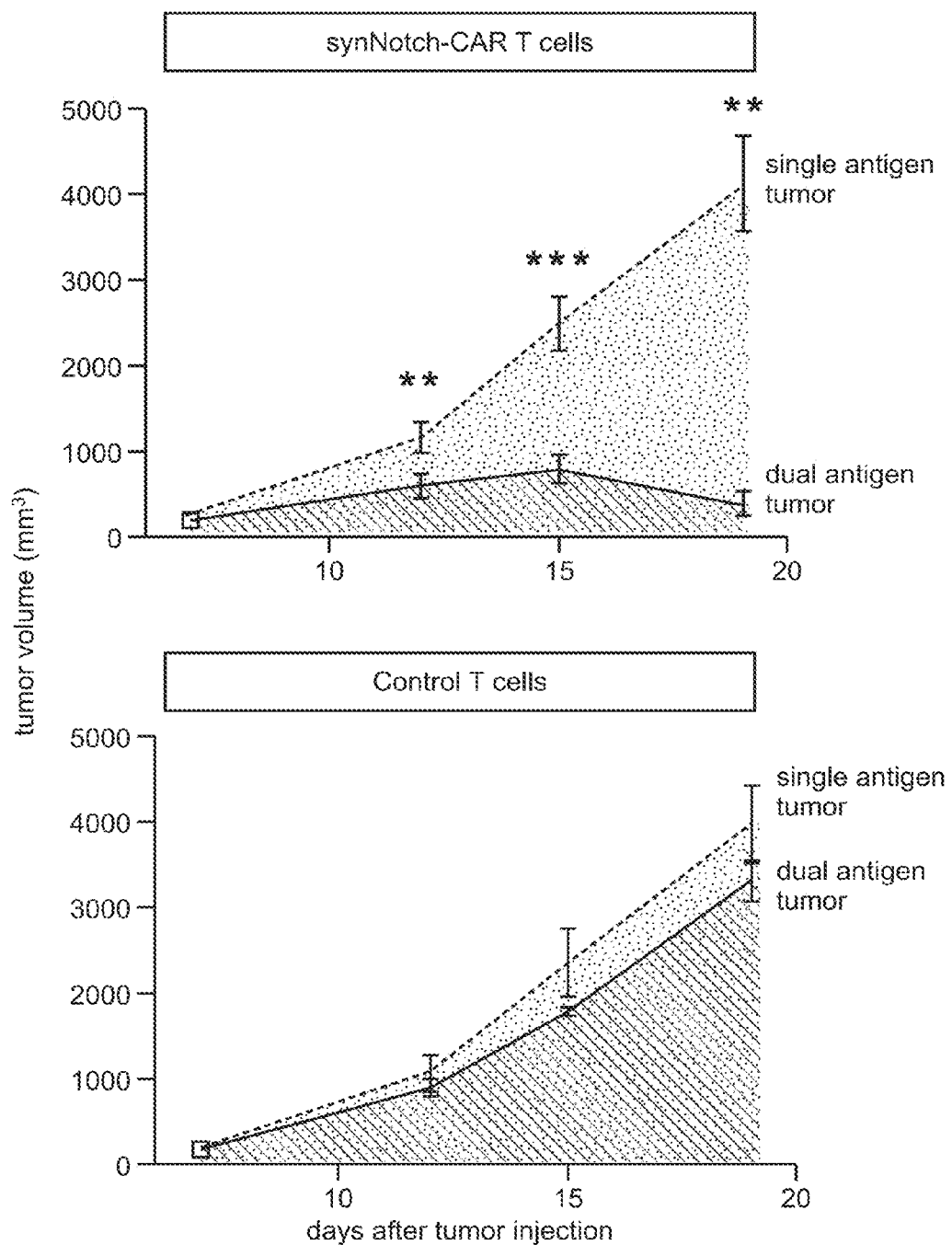
Figure 67A:
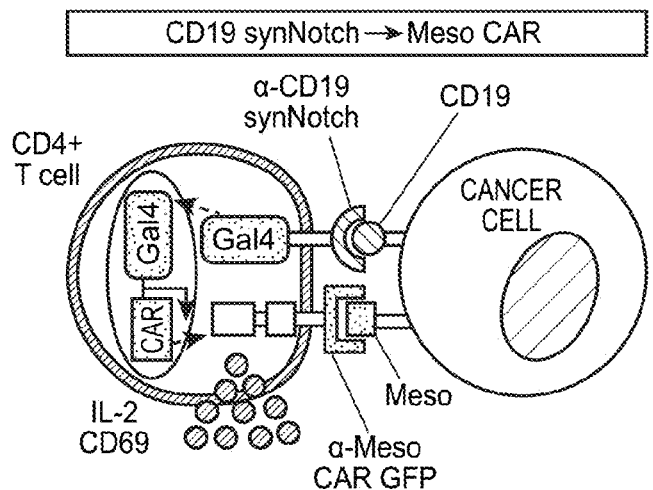
FIGS. 67A-67I provide supplemental data related to FIGS. 62A-62F.
Figure 67B:
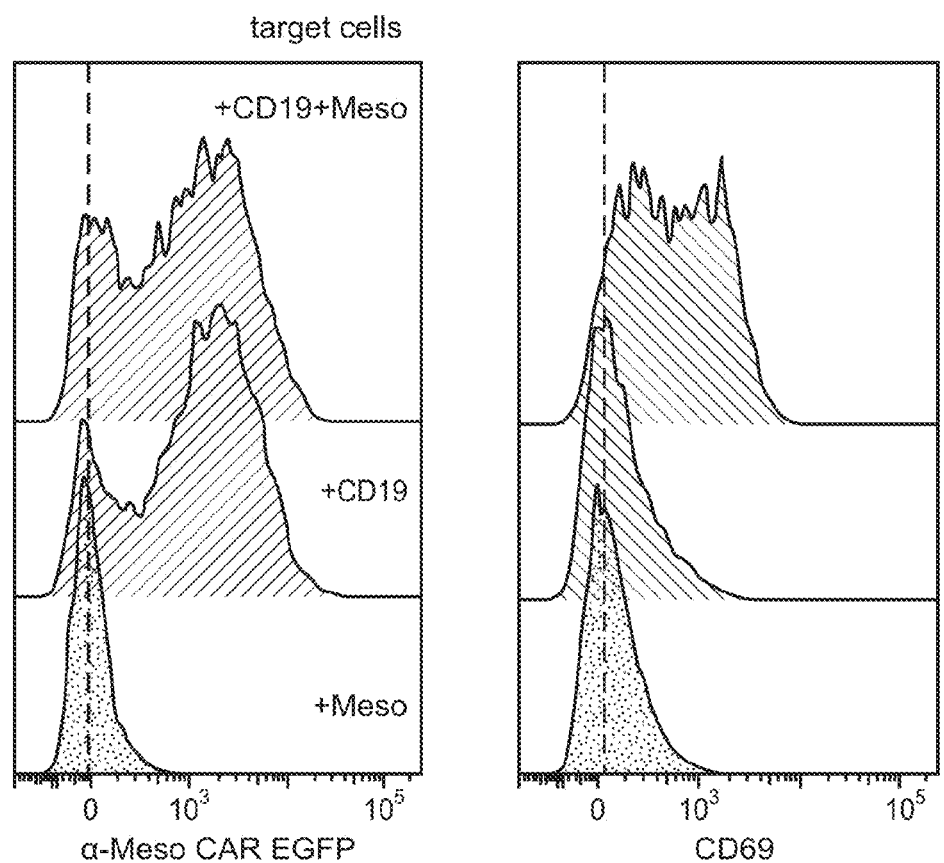
Figure 67C:
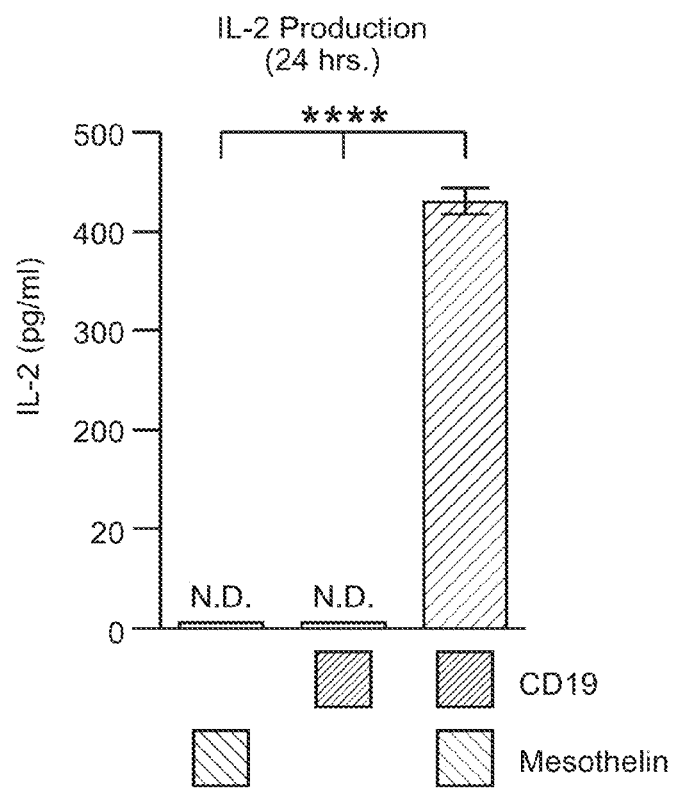
Figure 67D:
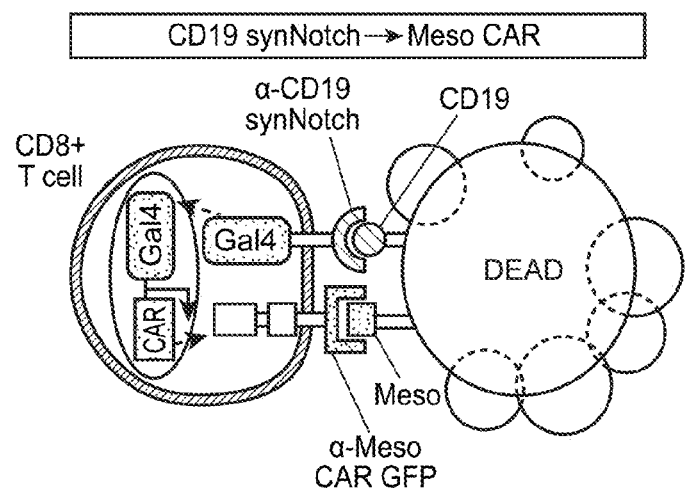
Figure 67E:
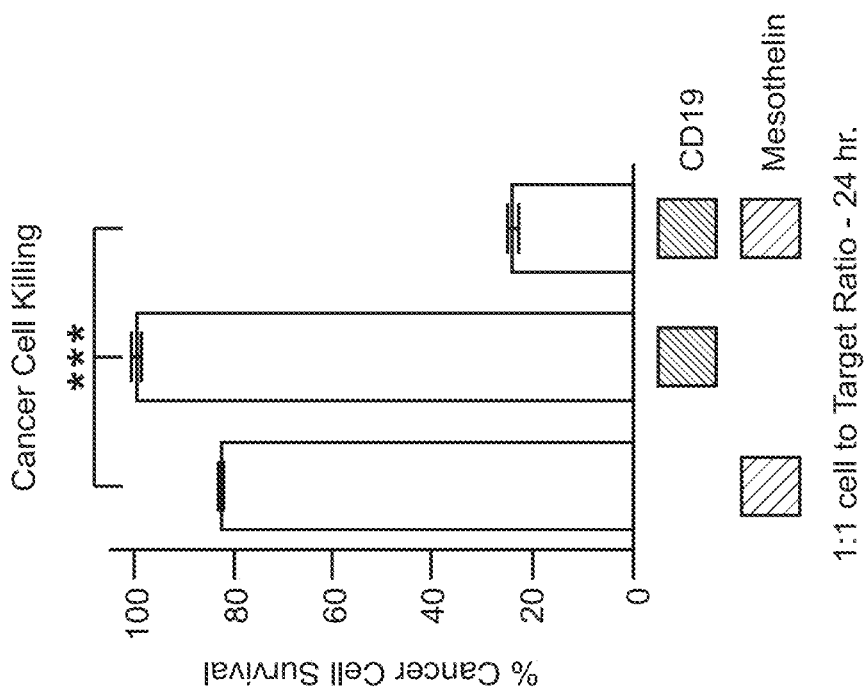
Figure 67F:
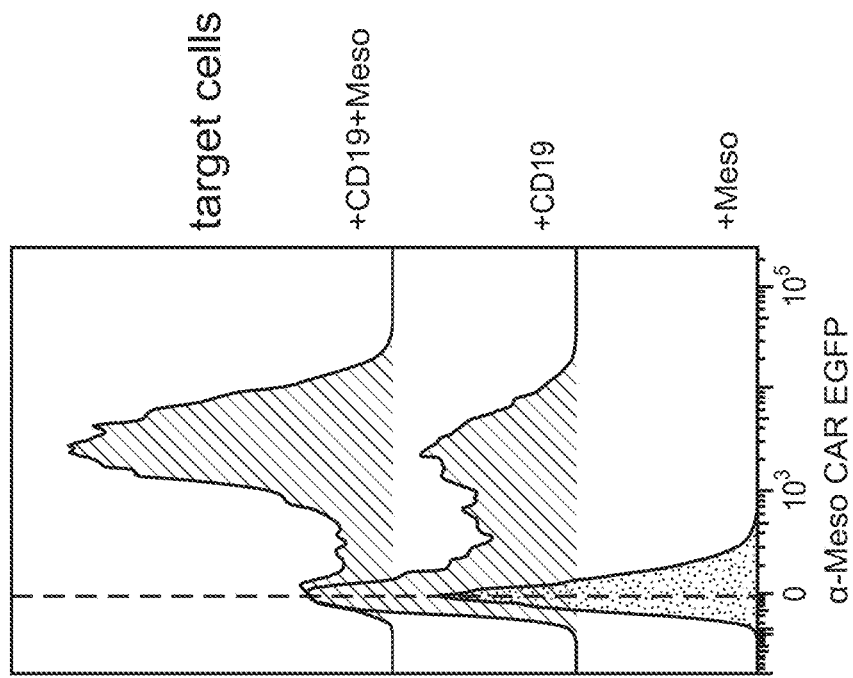
Figure 67H:
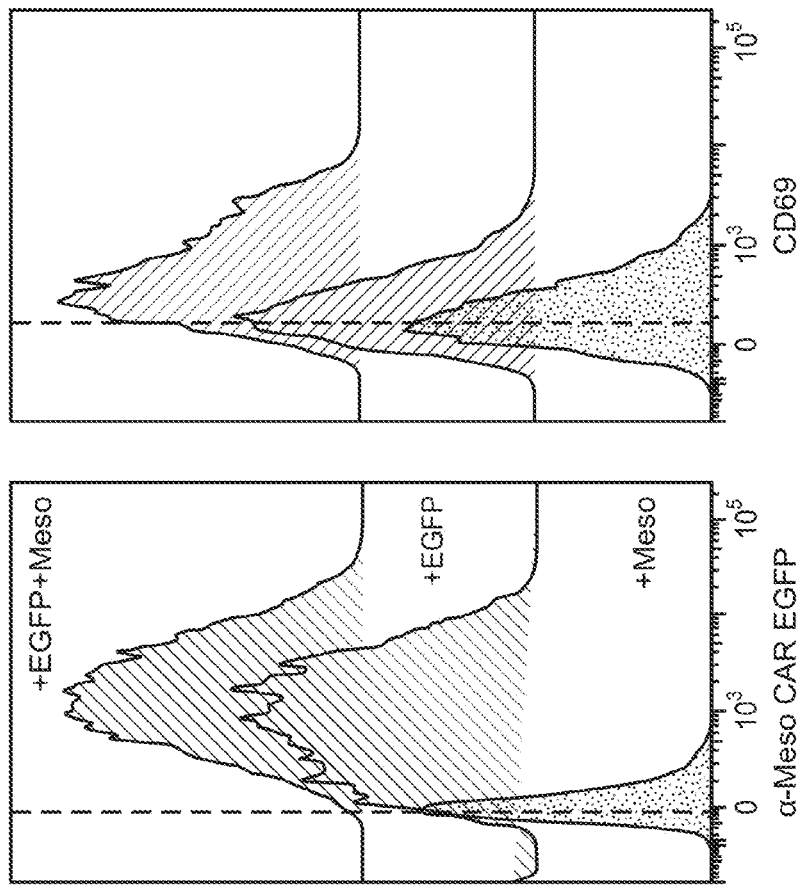
Figure 67G:
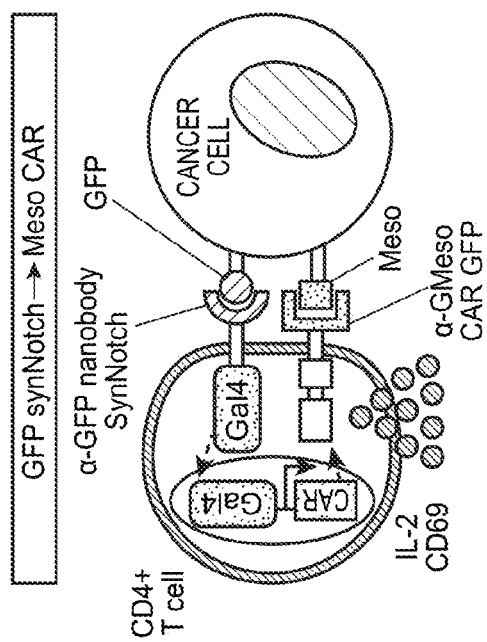
Figure 67I:
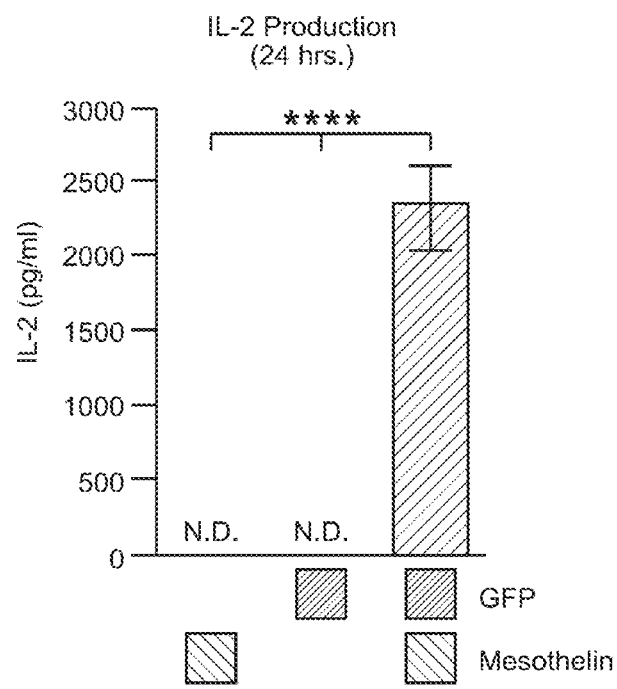
Figure 69A:
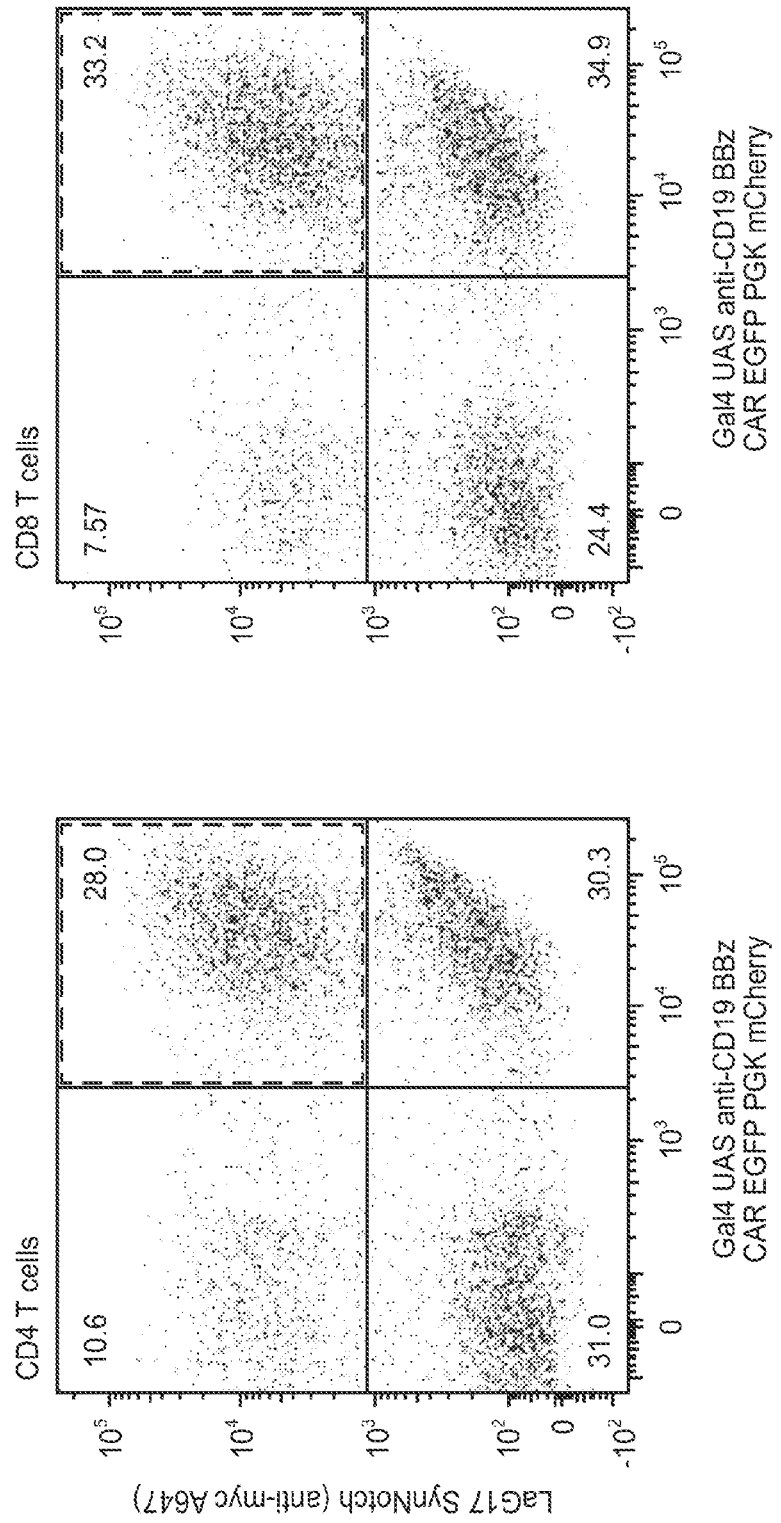
FIGS. 69A-69E provide supplemental data related to FIGS. 64A-64D.
Figure 69B:
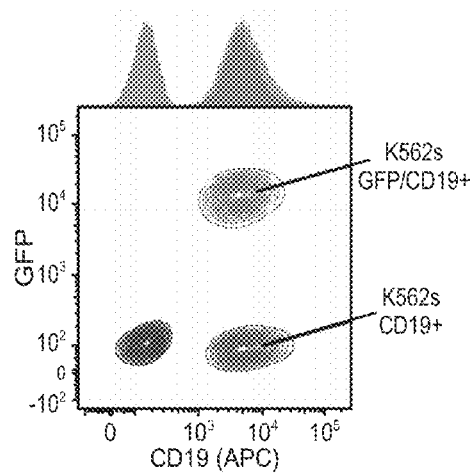
Figure 69C:
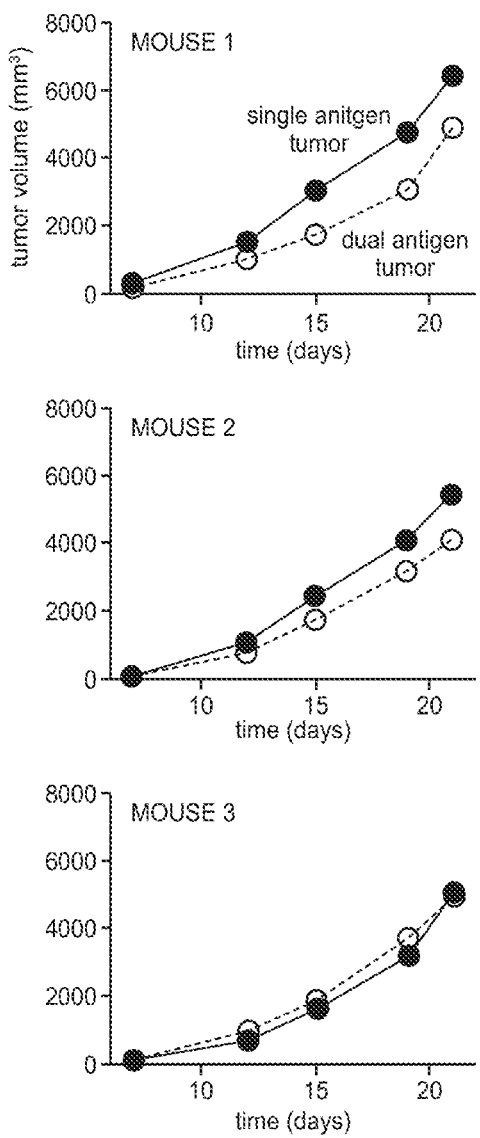

Highly Selective Combinatorial Antigen Tumor Clearance In Vivo by synNotch Gated CAR Expression It was shown that the α-GFP synNotch receptor could target T cells to tumors and control local expression of the α-CD19 CAR. It was then tested whether the synNotch AND gate T cells could selectively clear a dual antigen tumor in vivo. For these experiments, a similar bilateral tumor model was set up with K562 tumor cells (FIG. 64A and FIGS. 69A and 67B). The tumors were implanted and 4 days were allowed for implantation (K562 tumors grow more rapidly and establish large tumors compared to Daudi cells). At day 4, CD4+ and CD8+ T cells bearing the α-GFP synNotch→α-CD19 CAR AND gate circuit were injected, and tumor growth was monitored via caliper for 20 days (FIG. 64A). A group of mice was treated with untransduced control T cells to have a reference for tumor growth. In this experiment, the T cells are directly challenged to discriminate dual antigen "disease" tumors from single antigen "bystander" tissues, all within the same animal The synNotch AND gate T cells displayed remarkably high and reproducible discriminatory action against the two tumors in present in the same animal. In all animals they selectively cleared the dual antigen "disease" tumor (GFP/CD19+) while leaving the single antigen "bystander" tumor (CD19+ only) unperturbed. These bystander single antigen tumors grew at rates similar to the negative control tumor treated with untransduced T cells (FIG. 64B, 64C, 69B). Thus there is little detectable OFF-target killing of the "bystander" single antigen tumor.

Figure 64D:
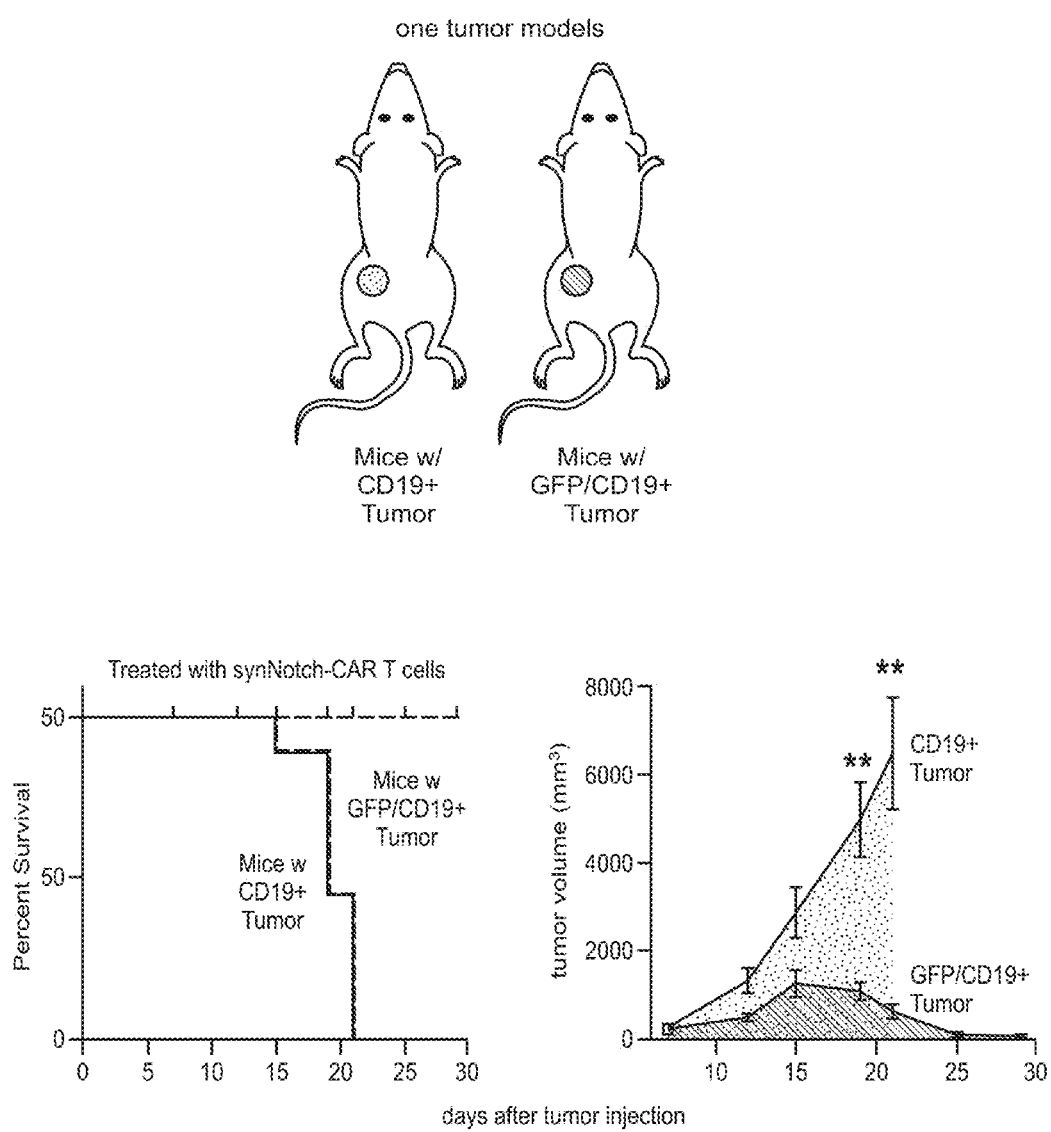

Single tumor experiments were set up, where mice were implanted with either a single antigen (CD19+ only) or a dual antigen (GFP/CD19+) K562 tumor. The mice were then treated with synNotch AND gate T cells or untransduced control T cells. The mice treated with control T cells all reached euthanasia criteria rapidly regardless of the tumor type. The mice with GFP/CD19 tumors treated with synNotch AND gate T cells all lived and the tumor was completely cleared by day 25 post tumor injection (FIG. 64D). Mice with CD19 only tumors treated with synNotch AND gate T cells reached euthanasia criteria at the same rate as mice treated with untransduced T cells suggesting there is no OFF-target killing of the single antigen tumor (FIG. 64D). These in vivo data collectively show that synNotch-gated CAR expression is an effective AND gate allowing T cells to confine their activity to the tumor microenvironment and only activate and kill in response to multiple antigens.

Figure 69D:
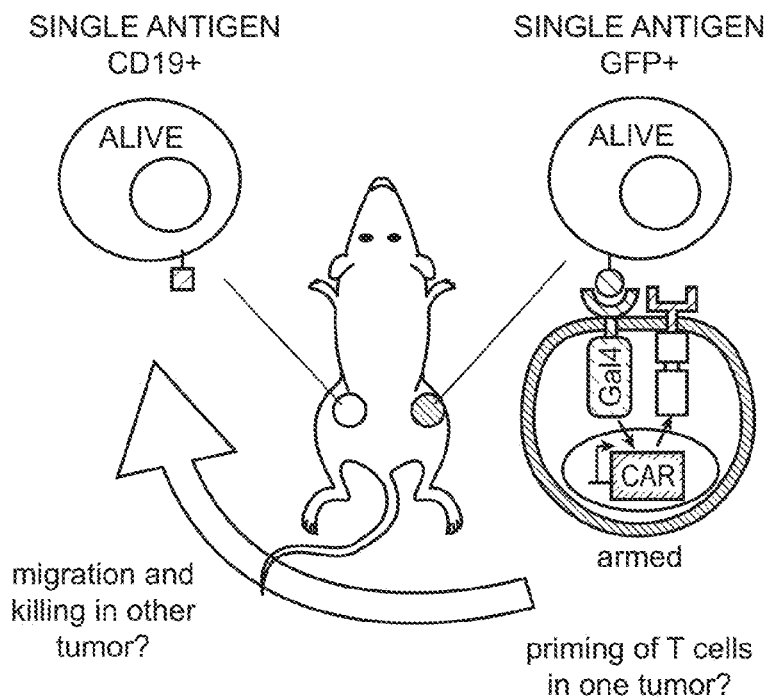
Figure 69E:
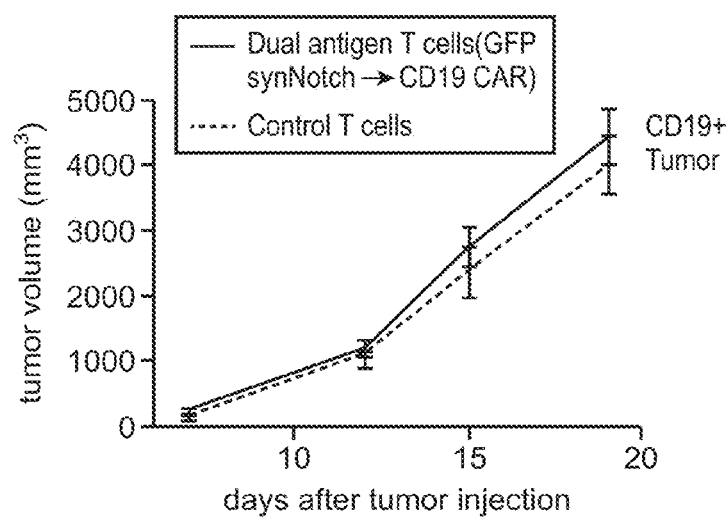

One concern was whether the AND-gate T cells could engage a tumor expressing the synNotch ligand (GFP), become primed by expressing the α-CD19 CAR, then migrate elsewhere to then kill single antigen (CD19+ only) bystander tissues. To test this, experiments were performed with a bilateral tumor model, but in this case used one tumor with CD19+ only cells and the other tumor with GFP+ only cells (i.e. two single antigen tumors) (FIG. 69D). In these mice, it would be possible for the T cells to be primed by the GFP+ only tumor, then kill the CD19+ only tumors. When growth of the CD19+ tumor was monitored using the AND gate cells, it was found that it was identical to the growth observed when treated with negative control T cells (untransduced). Thus, there appears to be no evidence for priming of the AND gate T cells and subsequent killing of bystander CD19+ cells elsewhere. It was hypothesized that in these AND gate T cells, the decay rate of induced CAR expression, is likely faster or comparable to the rate of migration out of the priming tumor, which would explain the requirement for highly local dual antigens.

FIG. 60. synNotch Receptors for Combinatorial Antigen Sensing in T Cells (A) CAR or tumor-specific TCR T cells generally target single antigens, thereby often causing OFF-target tissue damage. Improved therapeutic T cells will require multiple sensors that recognize combinations of both tumor antigens and tissue-specific antigens, allowing the cells to assess their environment and make more precise decisions on when to activate. Such therapeutic cells would be better equipped to distinguish target diseased tissue from normal tissue. (B) New types of receptors that sense combinations of antigens and regulate T cell signaling and transcription must be built to allow for sophisticated cellular decision-making and more precise therapeutic T cell responses. (C) synNotch receptors are engineered with a custom extracellular ligand-binding domain such as an scFv or nanobody directed towards an antigen of interest (e.g. tumor or tissue specific antigen). Upon ligand recognition by the synNotch receptor, an orthogonal transcription factor (e.g. TetRVP64 or Gal4VP64) is cleaved from the cytoplasmic tail that regulates a custom genetic circuit. (D) Design of a synNotch AND-gate circuits, which requires T cells to sense two antigens to activate. This AND-gate signaling circuit works in two sequential steps: 1) A synNotch receptor allows the T cell to recognize the first antigen A and 2) the T cell expresses a CAR directed towards a second tumor antigen B. If A and B are present, the T cells can activate and kill the target tumor.

FIG. 61. synNotch-Gated CAR Expression—Combinatorial Antigen Requirement for Jurkat T Cell Activation (A) Engineering a two receptor AND-gate circuit: α-CD19 synNotch receptor induces α-mesothelin CAR expression. (B) Jurkat T cells were engineered with the α-CD19 synNotch tTa receptor and the corresponding response elements controlling α-mesothelin CAR expression. The Jurkat T cells must first recognize CD19 on the target tumor via their synNotch receptor to initiate CAR expression. After the T cell is primed to activate by CD19, the α-mesothelin CAR can then bind mesothelin and activate the Jurkat cell. Two canonical markers of T cell activation are CD69 upregulation and IL-2 production. The synNotch AND gate Jurkat T cells should only activate when exposed to target tumor cells expressing both CD19 and Mesothelin. (C) Histograms of the activation marker CD69 in synNotch AND Gate Jurkat T cells co-cultured with single antigen (Mesothelin only) or dual antigen (CD19/Mesothelin) K562 tumor cells for 48 hours. CD69 was only expressed when the T cells were exposed to dual positive K562s (representative of 3 independent experiments)(D) IL-2 ELISA showing IL-2 production by synNotch AND-Gate Jurkats only when exposed to dual antigen K562s (n=3, error bars are SEM, significance determined by Student's t-test, ****=p≤0.0001)

FIG. 62. synNotch Gated CAR Expression in Human Primary T Cells—Combinatorial Antigen Control Over Therapeutic T Cell Activation and Tumor Killing (A) Human primary CD4+ and CD8+ T cells were engineered with the α-GFP nanobody synNotch Gal4VP64 receptor and the corresponding response elements controlling expression of the α-CD19 4-1BBζ CAR. These CD4+ or CD8+ synNotch AND gate T cells first must sense surface GFP via their synNotch receptor and only then do they express the α-CD19 CAR and are primed to activate. The synNotch AND gate primary T cells should only activate and produce cytokine or kill target cells if they sense both GFP and CD19. (B) Primary CD4+ synNotch AND gate T cells described in panel A were co-cultured with CD19 only or surface GFP/CD19 K562s. Histograms of α-CD19 CAR GFP receptor expression level show that the CAR is only expressed when GFP is present on the surface of the target cell (representative of at least 3 independent experiments). (C) The supernatant from CD4+ synNotch AND gate T cells activated either by CD19 only or GFP/CD19 K562s was analyzed for the presence of a 25 cytokines via Luminex. Cytokines were only produced when the T cells were exposed to GFP/CD19 T cells (error bars are SEM, n=3). (D) CD8+ synNotch AND gate primary T cells were engineered as described in panel A. As with the CD4+ T cells, the histograms of α-CD19 CAR GFP receptor expression level show that the CAR is only expressed when GFP is present on the surface of the target cell (representative of at least 3 independent experiments). (E) Forward and side scatter flow cytometry plots after 24 hour co-culture of CD8+ synNotch AND gate primary T cells with either CD19 only or GFP/CD19 tumors cells. The T cells fall within the blue gate and the target K562s are in the red gate. The synNotch AND gate T cells only killed the GFP/CD19 K562s shown by the reduction cells in the K562 gate (representative of 3 experiments). (F) Quantification replicate CD8+ synNotch AND gate primary T cell cytotoxicity data shown in panel E. (n=3, error bars are SEM, significance determined by Student's t-test *=p<0.05).

FIG. 63. synNotch Receptors Drive Tumor Localized CAR Expression In Vivo.

(A) Primary human CD4+ and CD8+ T cells were engineered with the α-GFP synNotch Gal4VP64 receptor and the corresponding response elements regulating α-CD19 4-1BBζ CAR IRES effluc expression and injected i.v. into mice with a Daudi tumor (CD19 only) on the left flank and a surface GFP Daudi (GFP/CD19) tumor on the right flank. Luciferase expression was monitored over 11 days after i.v. injection of engineered T cells. (B) A representative image of luciferase expression in mice treated as described in panel A at day 7 post T cell injection. Luciferase expression was high in the GFP/CD19 tumor only indicating localized CAR expression in the dual antigen tumor (n=2 mice) (C) Quantification of integrated intensity of luciferase levels in the left flank Daudi tumor (CD19 only) and surface GFP Daudi tumor (GFP/CD19) in the right flank. Luciferase expression is enriched in the dual antigen tumor at all time points (error is SD n=2).

FIG. 64. Selective Combinatorial Antigen Tumor Killing In Vivo by synNotch Gated CAR Expression (A) Primary human CD4+ and CD8+ T cells were engineered with the α-GFP synNotch Gal4VP64 receptor and the corresponding response elements regulating α-CD19 4-1BBζ CAR expression and were injected i.v. into mice with a CD19 K562s on the left flank and a surface GFP/CD19 K562 tumor on the right flank. Tumor size was monitored over 16 days after i.v. injection of engineered T cells or untransduced T cell controls. (B) Graphs showing CD19 and GFP/CD19 tumor volumes for mice treated with synNotch AND gate T cells (top) and untransduced control T cells (bottom). synNotch AND gate T cells target the dual antigen tumor exclusively and the CD19 only tumor grew at the same rate as in mice treated with untransduced control T cells (n=5 mice, error bars are SEM, significance determine by Student's t-test =p≤0.01, *=p≤0.001)(C) Tumor volume measurement for individual mice treated with syn-Notch AND gate T cells. All mice showed selective killing of the dual antigen tumor. (D) Kaplan-Meier graphs showing synNotch AND gate T cells clear GFP/CD19 tumors with 100% of the mice surviving. Mice with CD19 only tumors are not cleared by synNotch AND gate T cells and have uncontrolled tumor growth. The corresponding tumor growth curves are given on the right of panel D (n=5 mice, error bars are SEM, significance determine by Student's t-test **=p≤0.01).

Figure 65C:
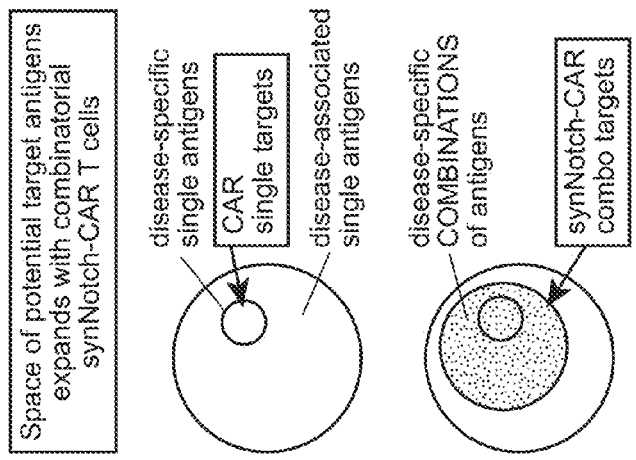
Figure 65B:
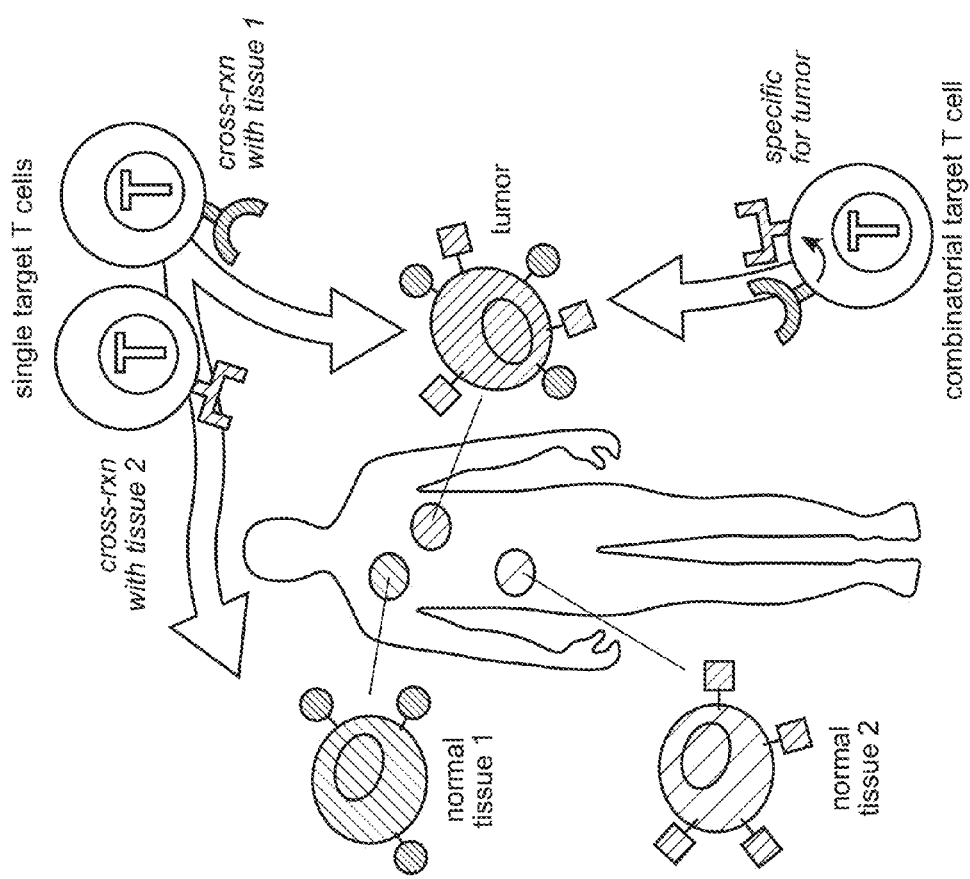

FIG. 65. synNotch Receptors Control and Localize CAR T Cell Response for Precision Immunotherapy.

(A) T cells were engineered with (genetically modified to produced) synNotch receptors that sense tumor antigens and upregulate expression of a CAR to a second antigen. Thus, these synNotch AND gate T cells only activate in response to combinatorial antigen recognition in the tumor microenvironment, preventing OFF-target toxicity mediated by single antigen recognition. (B) synNotch AND gate T cells unlike therapeutic T cells that target single antigens can reliably discriminate combinatorial antigen targets from single antigen bystander tissue. Combinatorial antigen sensing by synNotch-CAR T cells could aid in precisely targeting T cells to tumors preventing OFF-target toxicity. (C) Expansion of targetable antigen space. Tumor-specific antigens are rare compared to tumor-associated antigens (antigens that are expressed on normal tissue but are more highly expressed on tumors). Since CARs fully activate T cells resulting in the killing of target tissue, single CAR T cells must be targeted to tumor-specific antigens in order to reduce fatal OFF-target toxicity (top Venn diagram). synNotch receptors can gate CAR expression and control where the T cells are armed. When targeting tumor specific antigen combinations, it may now be possible to use CAR receptors directed towards tumor-associated antigens. This should reduce OFF-target damage to tissues that express the CAR antigen in other parts of the body.

FIG. 66. synNotch-Gated CAR Expression—Combinatorial Antigen Requirement for Jurkat T Cell Activation.

(A) α-CD19 synNotch Jurkat T cells controlling expression of the α-mesothelin CAR fused to GFP were incubated for 48 hours with Meso only or CD19 and Meso+ K562s. Histograms of α-mesothelin CAR GFP levels show that the CAR is only expressed when the Jurkats are exposed to CD19. (B) Plots of normalized α-mesothelin CAR GFP and CD69 levels calculated from histograms in panel A and FIG. 2B. The half time for maximal expression of the CAR and CD69 was 6 hours and 13 hours respectively. (C) synNotch AND gate Jurkat T cells were stimulated with plate-bound α-myc antibody that binds a myc-tag on the extracellular domain of the synNotch receptor for 24 hours. After 24 hours the cells were removed from the α-myc stimulus and CAR expression was monitored for 24 hours. (D) Histograms of α-mesothelin CAR GFP expression after removal of the synNotch stimulus. Normalized CAR is plotted and fit to a one-phase decay showing a 8 hour half-time of down regulation.

FIG. 67. synNotch Gated CAR Expression in Human Primary T Cells—Combinatorial Antigen Control Over Therapeutic T Cell Activation and Tumor Killing (A) CD4+ primary T cells were engineered with the α-CD19 synNotch Gal4VP64 receptor and the corresponding response elements controlling α-Mesothelin 4-1BBζ CAR EGFP expression. The T cells were then co-cultured with Mesothelin only, CD19 only, or CD19/Mesothelin K562s for 24 hours and CD69 upregulation and IL-2 production were assayed. (B) Histograms showing α-Mesothelin CAR EGFP levels and CD69 levels on CD4+ synNotch primary T cells cultured as described in panel A. The α-Mesothelin CAR was only expressed when CD19 was on the target K562s and the T cells only expressed the activation marker CD69 when both CD19 and Mesothelin were on the target K562s (representative of 3 experiments). (C) IL-2 levels from supernatant harvested from cultures described in panel A. IL-2 was only produced when the T cells were exposed to targets cell expressing both CD19 and Mesothelin (n=3, error bars are SEM, significance determined by Student's t-test *=p≤0.001). (D) CD8+ primary human T cells were engineered as described in panel A. For CD8+ T cells specific cytotoxicity of Mesothelin only, CD19 only, or CD19/Mesothelin target K562s was determined. The synNotch AND gate CD8+ T cells should only kill dual positive K562s. (E) Histograms showing α-Mesothelin CAR EGFP levels on CD8+ synNotch primary T cells cultured as described in panel A. The α-Mesothelin CAR was only expressed when CD19 was on the target K562s (representative of 3 experiments). (F) Quantification replicate CD8+ synNotch AND gate primary T cell cytotoxicity showing specific killing of target K562s with both CD19 and Mesothelin expression (n=3, error bars are SEM, *=p≤0.001). (G) CD4+ primary T cells were engineered with the α-GFP nanobody synNotch Gal4VP64 receptor and the corresponding response elements controlling α-Mesothelin 4-1BBζ CAR EGFP expression. The T cells were then co-cultured with Mesothelin only, GFP only, or GFP/Mesothelin K562s for 24 hours and CD69 upregulation and IL-2 production were assayed. (H) Histograms showing α-Mesothelin CAR EGFP levels and CD69 levels on CD4+ synNotch primary T cells cultured as described in panel G. The α-Mesothelin CAR was only expressed when GFP was on the target K562s and the T cells only expressed the activation marker CD69 when both GFP and Mesothelin were on the target K562s (representative of 3 experiments). (I) IL-2 levels from supernatant harvested from cultures described in panel G. IL-2 was only produced when the T cells were exposed to targets cell expressing both GFP and Mesothelin (n=3, error bars are SEM, ****=p≤0.0001).

FIG. 68. synNotch Receptors Drive Tumor Localized CAR Expression In Vivo.

(A) Representative dot plots showing expression of the α-GFP synNotch Gal4VP64 receptor and the corresponding response elements regulating α-CD19 4-1BBζ CAR IRES effluc in primary CD4+ and CD8+ T cells. The T cells outlined by the red box were sorted and used for in vivo and in vitro experiments. (B) Bar graph showing luciferase activity in synNotch AND CD4+ and CD8+ T cells from panel A after exposure for 24 hours with GFP− or GFP+ K562s. Luciferase was specifically expressed in response to GFP (n=3, error bars are SEM, ****=p≤0.0001). (C) Tumor growth curves are given for mice analyzed in FIG. 4C.

FIG. 69. Selective Combinatorial Antigen Tumor Killing In Vivo by synNotch Gated CAR Expression (A) Representative dot plots engineered showing the expression of the α-GFP synNotch Gal4VP64 receptor and the corresponding response elements regulating α-CD19 4-1BBζ CAR in primary human CD4+ and CD8+ T cells. The T cells red boxed quadrant were sorted and used for experiments in FIG. 64. (B) Flow cytometry plots showing the expression of CD19 (purple) and GFP and CD19 (green) in K562s utilized for in vitro and in vivo experiments. (C) Tumor growth curves for individual mice with bilateral CD19 (left flank) and GFP and CD19 (right flank) tumors treated with control untransduced CD4+ and CD8+ T cells. The data underlies FIG. 5B lower panel. (D) Primary human CD4+ and CD8+ T cells were engineered with the α-GFP synNotch Gal4VP64 receptor and the corresponding response elements regulating α-CD19 4-1BBζ CAR expression and were injected i.v. into mice with a CD19 K562s on the left flank and a surface GFP K562 tumor on the right flank to test if the T cells migrate from the GFP+ 'priming tumor' and kill the OFF-target CD19 only tumor. Tumor size was monitored over 16 days after i.v. injection of engineered T cells or untransduced T cell controls. (E) Graph showing CD19 tumor volumes for mice treated with synNotch AND gate T cells (solid line) or untransduced control T cells (dotted line). The CD19 tumor is not targeted suggesting there is no migration of primed T cells from the GFP+ tumor (n=5, error bars are SEM, no significant difference at any timepoints based on student's t test, p>0.05).

Example 6: SynNotch Induced Expression of Foxp3 in Human CD4 T Cells

Figure 70:
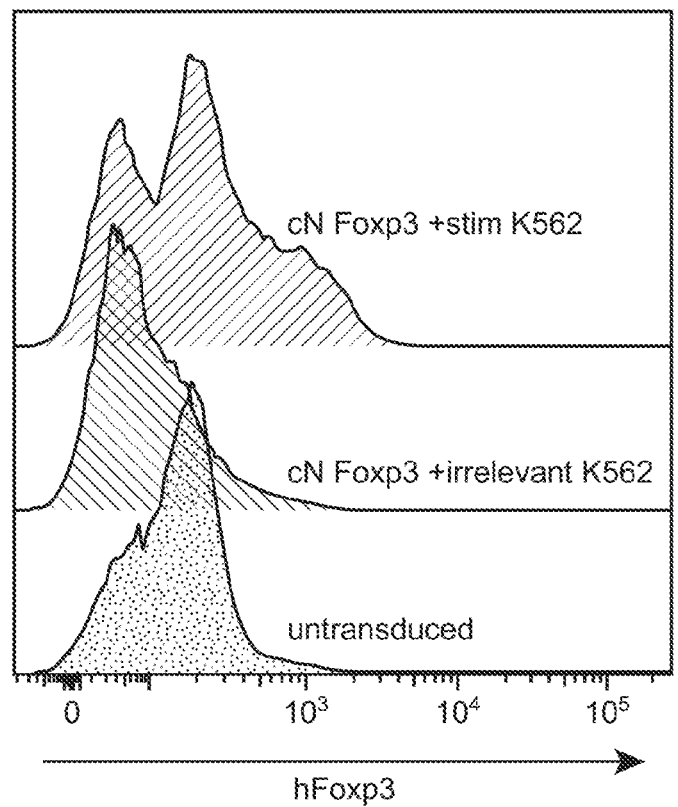
FIG. 70 demonstrates the induction of Foxp3 expression in human T cells using synNotch.

Direct intracellular staining of Foxp3 was used to measure Foxp3 induction in human CD4 T cells expressing anti-CD19 synNotch. Anti-CD19 synNotch expressing CD4 T cells were stimulated with either CD19+ (CD19 positive) K562 cells or CD19− (CD19 negative) K562 cells. Foxp3 was induced in CD19 synNotch cells when stimulated with the CD19+ K562 cells (FIG. 70, "cN Foxp3+stim K562"). In comparison, induction was not seen when the CD19 synNotch cells were stimulated with CD19− K562 cells (FIG. 70, "cN Foxp3+irrelevant K562"). Untransduced cells were used as a negative control (FIG. 70, "untransduced").

Induction of Foxp3, a master regulator of the regulatory pathway in the development and function of regulatory T cells, using a CD19 responsive SynNotch demonstrates local antigen driven induction of regulatory T cell fate.

Figure 71:
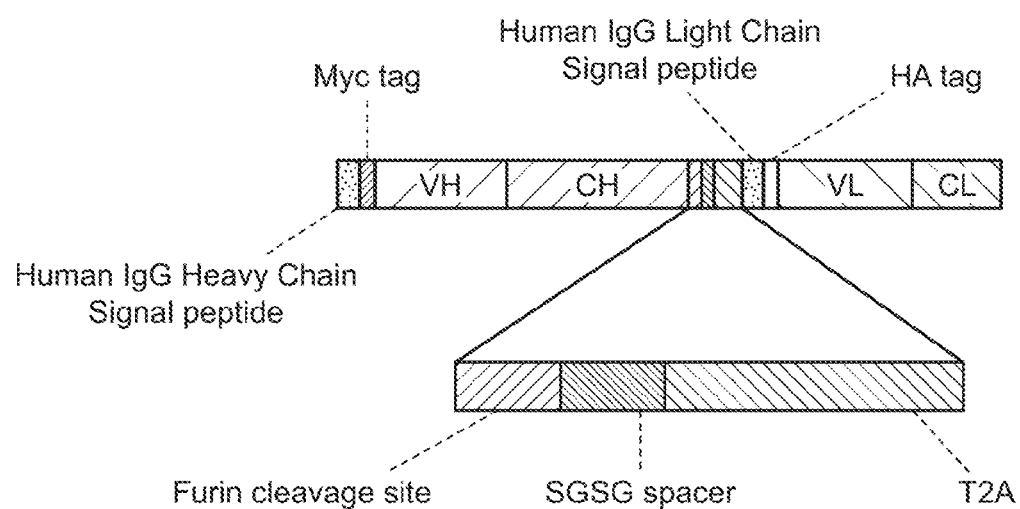
FIG. 71 provides a general antibody construct design for SynNotch controlled antibody secretion from human T cells.

Example 7: Controlled Antibody Production by Anti-CD19 SynNotch Expressing CD4 T Cells Antibody expression constructs were designed for human T cell synNotch induced antibody secretion. A schematic showing the general antibody construct design is provided in FIG. 71. In FIG. 71, from left to right, the domains of the general construct design are human IgG heavy chain signal peptide, Myc tag, VH domain, CH domain, furin cleavage site, SGSG spacer, T2A sequence, human IgG light chain signal peptide, HA tag, VL domain and CL domain Constructs were designed for synNotch induced secretion of the following antibodies: pembrolizumab (anti-PD-1), Tremelimumab (anti-CTLA4) and 9E10 (anti-myc).

Figure 72:
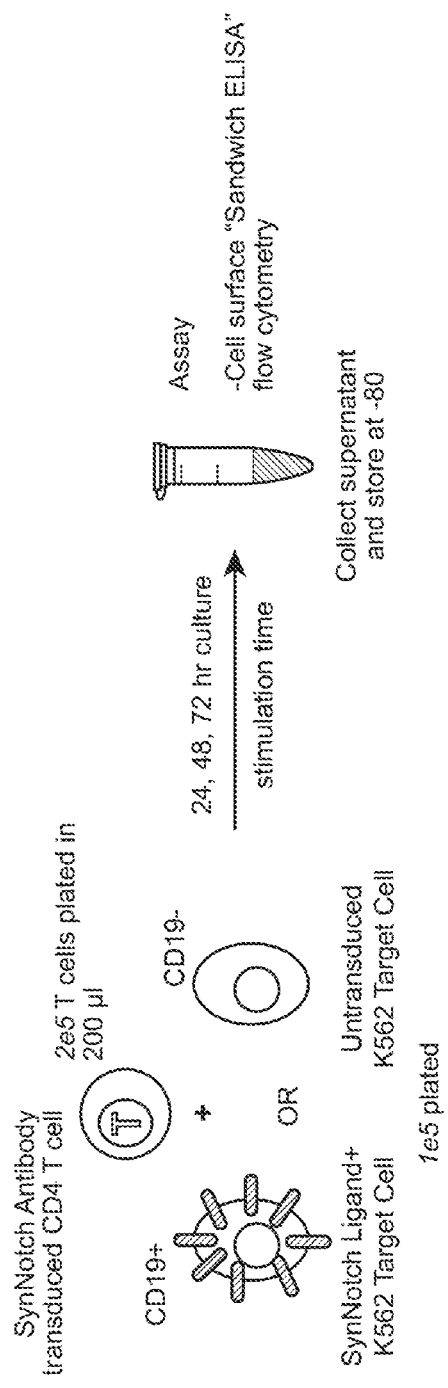
FIG. 72 provides a schematic representation of an in vitro assay used to test SynNotch induced antibody secretion.

A general scheme for an in vitro assay used to test SynNotch induced antibody secretion is provided in FIG. 72. Briefly, CD4 T cells were transduced with an anti-CD19 synNotch construct that, when activated, drives expression from an introduced antibody construct (see e.g., FIG. 71) and subsequent secretion of the antibody. Expression of the antibody construct is activated by the anti-CD19 synNotch intracellular domain, in this case a tTA intracellular domain.

In the assay, such transduced T cells were contacted with either CD19 expressing (CD19+; also referred to as "synNotch ligand+") K562 target cells or untransduced (CD19−) K562 target cells. The transduced CD4 T cells and the K562 target cells were co-cultured for 24, 48 and 72 hours prior to collection of culture supernatant.

Figure 73:
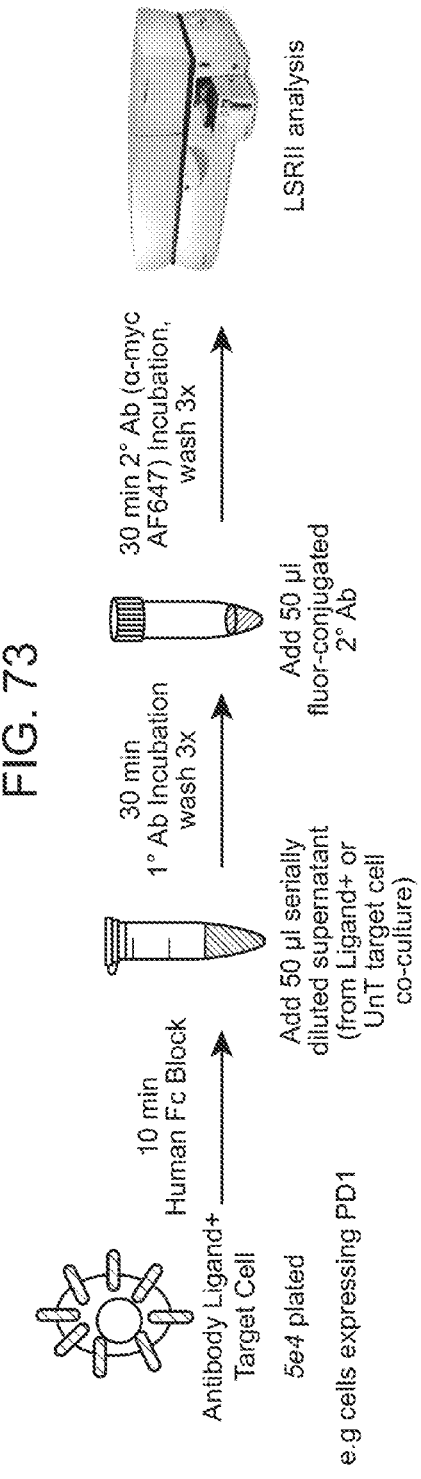
FIG. 73 provides a schematic representation of a cell surface "Sandwich ELISA" flow cytometry assay.

Antibody secreted by the anti-CD19 synNotch CD T cells was quantified by a cell surface "Sandwich ELISA" flow cytometry assay (see FIG. 73). Briefly, cells expressing the antibody ligand ("antibody ligand+ target cell"), i.e., cells expressing PD-1 in the case of the pembrolizumab antibody assay, were subjected to a 10 min. human Fc Block. Following blocking, 50 μl of serially diluted supernatant from either CD19+ or CD19− target cell co-culture was added and incubated with the cells for 30 min. Following primary antibody incubation, the cells were washed three times and 50 μl of fluorescent conjugated secondary antibody was added. In the instant case, anti-myc-AF647 was used as the secondary antibody and the secondary incubation was performed for 30 min. Following incubation with secondary antibody, the cells were washed three times and then subjected to analysis with a BD LSR II flow cytometer.

Figure 74:
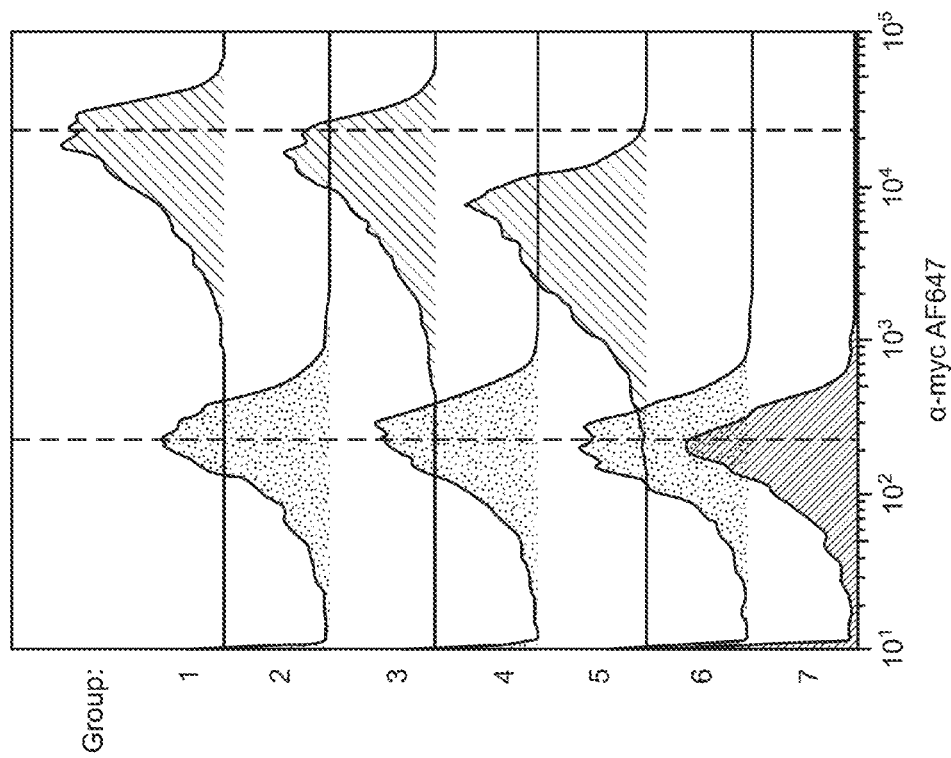
FIG. 74 demonstrates that SynNotch T cells can be induced to produce a heterologous antibody in response to antigen stimulation.

The results of this analysis for SynNotch T cells modified to secrete pembrolizumab are provided in FIG. 74. From top to bottom in FIG. 74, the results correspond to the following test groups:

TABLE 1

| Group | Stimulus | Primary Incubation | Co-culture Time |
|---|---|---|---|
| 1 | CD19+ K562 cells | Ligand + K562 supernatant | 72 hours |
| 2 | CD19− K562 cells | Untransduced K562 supernatant | 72 hours |
| 3 | CD19+ K562 cells | Ligand + K562 supernatant | 48 hours |
| 4 | CD19− K562 cells | Untransduced K562 supernatant | 48 hours |
| 5 | CD19+ K562 cells | Ligand + K562 supernatant | 24 hours |
| 6 | CD19− K562 cells | Untransduced K562 supernatant | 24 hours |
| 7 | Not Applicable | PBS | Not Applicable |

PD-1 expressing target cells showed high anti-myc-AF674 secondary staining when incubated with supernatant from anti-CD19 synNotch T cells co-cultured with CD19 expressing K562 cells ("Ligand+ K562 supernatant") which increased with increasing co-culture time (24 h, 48 h and 72 hr). In comparison, PD-1 expressing target cells showed low anti-myc-AF674 secondary staining when incubated with supernatant from anti-CD19 synNotch T cells co-cultured with untransduced (CD19−) K562 cells ("untransduced K562 supernatant").

Figure 91:
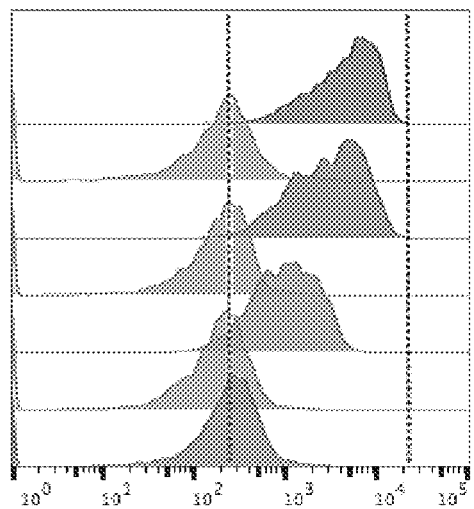
FIG. 91 provides the results of an analysis, similar to the analysis performed in FIG. 74, of SynNotch CD4 T cells modified to conditionally secrete pembrolizumab.
Figure 92:
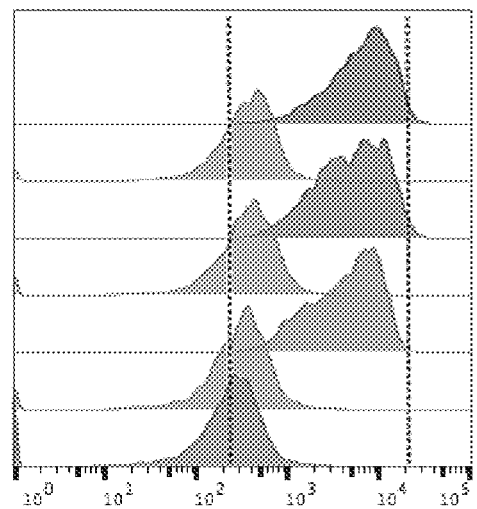
FIG. 92 provides the results of an analysis, similar to the analysis performed in FIG. 74, of SynNotch E6-1 Jurkat cells modified to secrete pembrolizumab.
Figure 93:
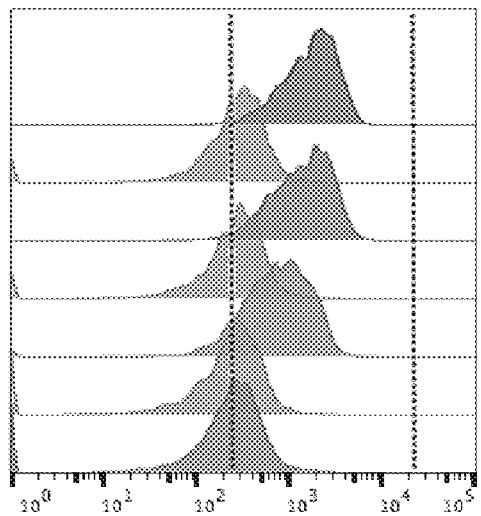
FIG. 93 provides the results of an analysis, similar to the analysis performed in FIG. 74, of SynNotch E6-1 Jurkat cells modified to secrete pembrolizumab using an alternative construct.
Figure 94:
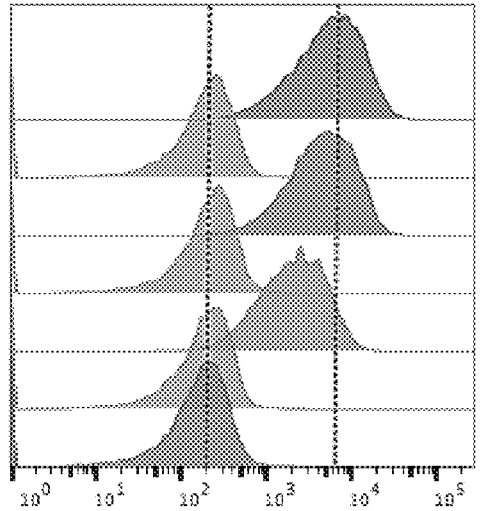
FIG. 94 provides the results of an analysis, similar to the analysis performed in FIG. 74, of SynNotch CD4 T cells modified to secrete Tremelimumab.
Figure 95:
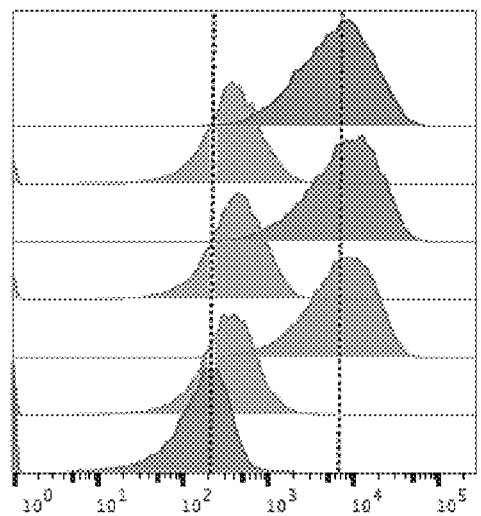
FIG. 95 provides the results of an analysis, similar to the analysis performed in FIG. 74, of SynNotch E6-1 Jurkat cells modified to secrete Tremelimumab.

This data demonstrates that anti-CD19 synNotch T cells were induced by CD19 expressing (CD19+) K562 cells to express and secrete the heterologous pembrolizumab antibody. Correspondingly, anti-CD19 synNotch T cells were not induced to secrete pembrolizumab when co-cultured with untransduced K562 cells. FIG. 91 provides the results of a similar analysis of SynNotch CD4 T cells modified to secrete pembrolizumab with an alternative expression construct, UAS_Prembro_IRES_mC_pGK_tBFP. FIG. 92 provides the results of a similar analysis of SynNotch E6-1 Jurkat cells modified to secrete pembrolizumab using the construct of FIG. 90. FIG. 93 provides the results of a similar analysis of SynNotch E6-1 Jurkat cells modified to secrete pembrolizumab using the alternative construct of FIG. 91. FIG. 94 and FIG. 95 provides the results of a similar analysis of SynNotch CD4 T cells and E6-1 Jurkat cells, respectively, modified to secrete Tremelimumab (anti-CLTA4) with UAS_tremelimumab_pGK_mC expression construct. Each row of data presented in FIGS. 91-95 generally corresponds to the groups presented above in Table 1.

Accordingly, SynNotch can be used to induce production of heterologous antibodies in human CD4 T cells where the antibody is produced only when the SynNotch cell is stimulated by the corresponding antigen (e.g., CD19). As such, in one embodiment, the SynNotch system can be used to direct the local production of therapeutic antibodies in response to recognition of a specific target antigen.

Example 8: Split SynNotch Modulation with an Adapter Molecule

Figure 75:
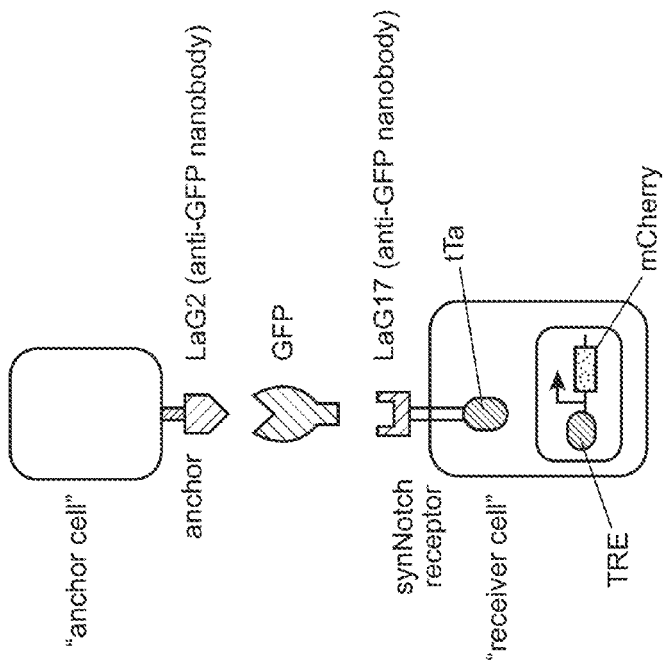
FIG. 75 provides a schematic representation of a split SynNotch signaling system.

A split SynNotch signaling system was constructed having two different anti-GFP nanobodies that bind different epitopes of GFP where one nanobody ("LaG2") is expressed on an "anchor cell", the other nanobody ("LaG17") is expressed on a "receiver cell" as a portion of a SynNotch receptor and GFP serves as a soluble adapter (see FIG. 75). The LaG17 nanobody SynNotch receptor was engineered to have a tTa intracellular domain that, upon activation, induces expression of an mCherry reporter from a TRE expression construct. Accordingly, in the designed split SynNotch system addition of the soluble adapter molecule (i.e., GFP) induces SynNotch signaling in the receiver cell only in the presence of the anchor cell.

The components of the described split SynNotch system were expressed in their corresponding cells in co-culture. Specifically, surface bound LaG2 anti-GFP nanobody was expressed in L929 cells (i.e., "anchor cells") and SynNotch with extracellular LaG17 anti-GFP nanobody and intracellular tTa was expressed in "receiver cells" having a TRE/mCherry expression reporter cassette. As a negative control, receiver cells were co-incubated with L929 cells that do not express the surface bound LaG2 (i.e., the "anchor"). GFP was added to the co-culture medium at serial concentrations (0 nM, 0.1 nM, 1 nM, 10 nM and 1000 nM) and mCherry expression, as an indication of receiver cell activation, was quantified by flow cytometry.

Figure 76:
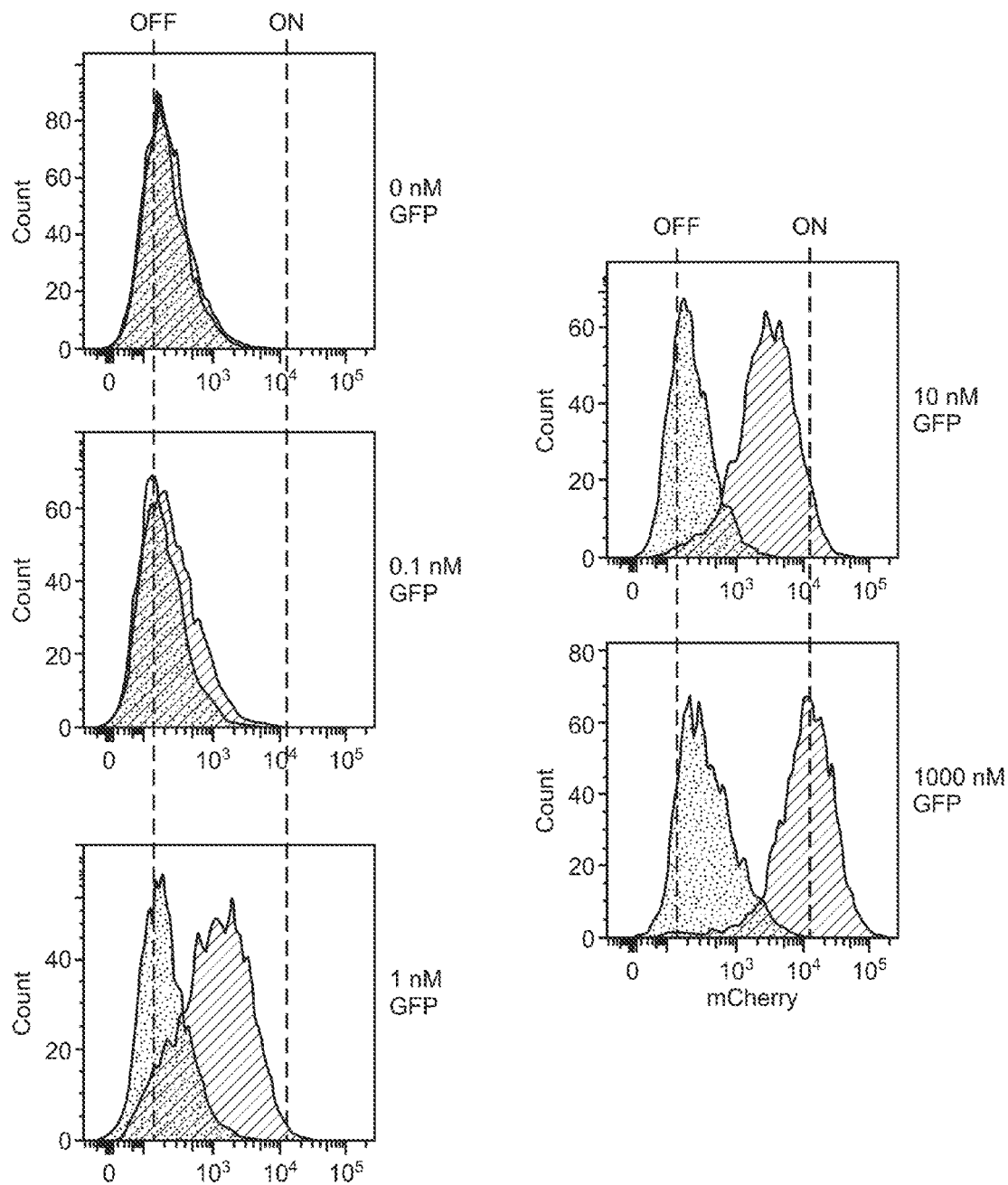
FIG. 76 demonstrates receiver cell activation at various concentrations of soluble adapter molecule according to an embodiment of a split SynNotch signaling system of the instant disclosure.

Receiver cell activation was only observed in the presence of LaG2 expressing anchor cells and mCherry expression was GFP "adapter" dose dependent (see FIG. 76). At 0 nM purified GFP added to receiver cells co-incubated with L929 anchor cells expressing LaG2 the receiver cells remained "OFF" (i.e., mCherry expression was essentially the same as that of receiver cells co-incubated with L929 negative control cells and the two peaks overlap). At increasing concentrations of purified soluble GFP, activation (as indicated by mCherry expression) was observed in receiver cells co-incubated with L929 anchor cells expressing LaG2 (the right most peaks in 0.1 nM, 1 nM, 10 nM and 1000 mM GFP). Even in the presence of increasing concentrations of GFP, receiver cells co-incubated with L929 negative control cells were not activated and remained "OFF" (left most peaks in 0.1 nM, 1 nM, 10 nM and 1000 mM GFP).

Accordingly, receiver cell activation was dependent on the presence of both the partner anchor cell and a sufficient concentration of the soluble GFP adapter molecule. Thus, receiver cell activation can be controlled both spatially, through the local presence of the anchor cell, and conditionally by modulating the presence of a sufficient concentration of the adapter molecule.

The split SynNotch signaling paradigm was used to further demonstrate a 3 cell system where receiver cell activation is modulated by a soluble adapter produced by a cell of the system.

Figure 78:
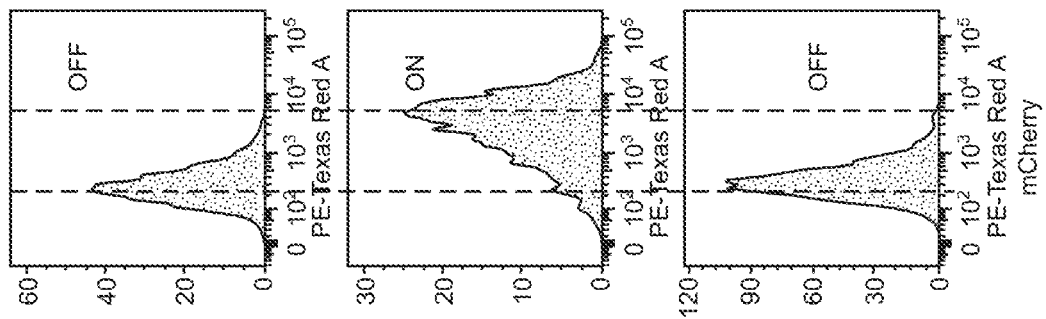
FIG. 78 demonstrates SynNotch receiver cell activation in a three cell split SynNotch signaling system according to an embodiment of the instant disclosure.
Figure 77:
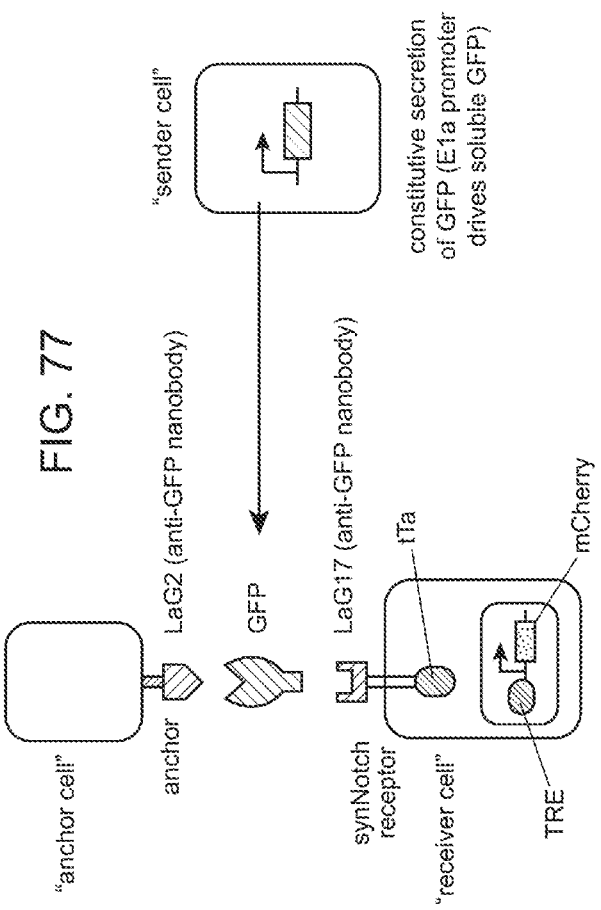
FIG. 77 provides a schematic representation of a three cell split SynNotch signaling system according to an embodiment of the instant disclosure.

A schematic representation of a three cell split SynNotch signaling system is provided in FIG. 77. Briefly, the two cell split SynNotch system described above in FIG. 75 was utilized, however, a third cell was added to the system which constitutively secretes GFP. Termed the "sender cell", soluble GFP is expressed from an expression cassette under control of the constitutively active E1a promoter. Using a ratio of sender cells to receiver cells to anchor cells of 0.5:0.25:0.25, co-incubation of receiver cells with anchor cells expressing surface LaG2 anti-GFP nanobody in the presence of sender cells secreting GFP, activation of the receiver cells (as indicated by increased mCherry expression) was seen (see FIG. 78, middle panel, "ON"). In comparison, when the same ratio of cells was used but the anchor cells were replaced with negative control L929 cells that do no expression LaG2, no receiver cell activation was seen (see FIG. 78, top panel, "OFF"). In addition, when the ratio was altered to contain few GFP expressing sender cells (ratio of sender cells to receiver cells to anchor cells of 0.01:0.495:0.495), receiver cells were also not activated (see FIG. 78, bottom panel, "OFF").

Accordingly, receiver cell activation was dependent on the presence of both the partner anchor cell and a GFP expressing send cells. Thus, receiver cell activation can be controlled both spatially, through the local presence of the anchor cell, and conditionally by modulating the presence of adapter molecule expressing cells. An additional level of control is available by modulating the expression of the adapter molecule within sender cells, e.g., by use of a regulatable promoter during expression of the adapter molecule in the sender cell.

The three cell split SynNotch signaling system allows for multi-input control of synNotch signaling. In addition, by controlling the expression and secretion of the diffusible adapter from the sender cell, SynNotch activation is not necessarily dependent on adjacent cell-cell contact and may be tuned spatially based on the radius of diffusible secreted adapter.

The split SynNotch signaling paradigm was used to further demonstrate a 3 cell system where inhibition of receiver cell activation is modulated by a soluble adapter produced by a cell of the system.

Figure 79:
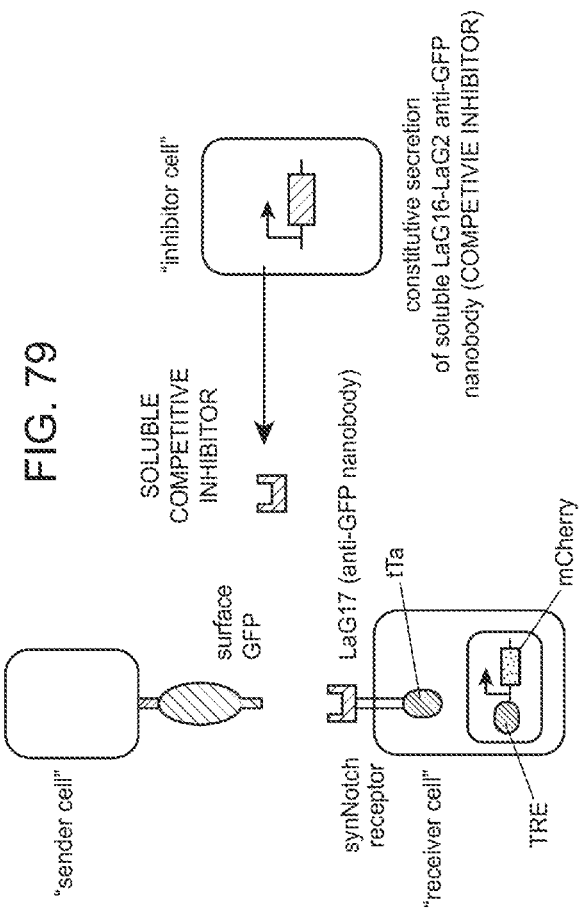
FIG. 79 provides a schematic representation of a three cell split SynNotch inhibitory signaling system according to an embodiment of the instant disclosure.

A schematic representation of a three cell split SynNotch inhibitory signaling system is provided in FIG. 79. The receiver cell of the two split SynNotch system described above in FIG. 75 was utilized. A surface expressed GFP cell was utilized as the "sender cell" which activates the "receiver cell" upon binding of the surface expressed GPF to the LaG17 anti-GFP nanobody portion of the receiver cell expressed SynNotch. Similar to above, activation of the receiver cell can be quantified by measuring expression from a TRE/mCherry reporter cassette. The third cell of this system, termed the "inhibitor cell", constitutively expresses soluble LaG16-LaG2 anti-GFP nanobody which acts as a competitive inhibitor for the binding of the surface expressed GFP of the sender cell and the LaG17 of the receiver cell. Thus, introduction of inhibitor cells to a co-culture of sender cells and receiver cells competitively inhibits binding between the sender cells and receiver cells, inhibiting activation of the receiver cells which can be measured by reduced mCherry expression.

Figure 80:
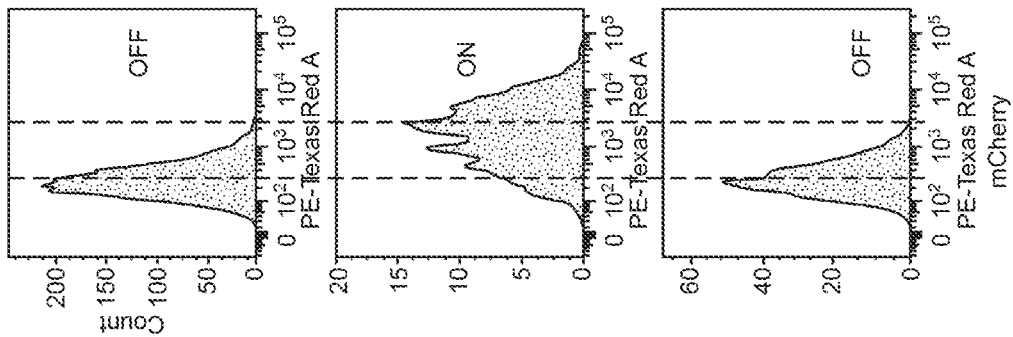
FIG. 80 demonstrates inhibition of SynNotch receiver cell activation in a three cell split SynNotch inhibitory signaling system according to an embodiment of the instant disclosure.

A control culture of receiver cells only, i.e., a culture of receiver cells that did not contain sender or inhibitor cells, did not result in activation of the receiver cells (see FIG. 80, top panel "OFF"). Activation of receiver cells was seen in a co-culture containing sender cells, receiver cells and negative control inhibitor cells of the parental L929 cell line that do not express the competitive inhibitor (ratio of sender cells to receiver cells to negative control inhibitor cells of 0.25: 0.25:0.5) (see FIG. 80, middle panel "ON"). When the same cell ratio was utilized (0.25:0.25:0.5) in a co-culture of sender cells, receiver cells and inhibitor cells that express the competitive inhibitor (sLaG16-LaG2-expressing L929 cells) inhibition of receiver cell activation was observed as indicated by a decrease in mCherry expression (see FIG. 80, bottom panel "OFF").

Accordingly, receiver cell activation, which was dependent on binding of the SynNotch of the receiver cell to the surface GFP of the sender cell, was inhibited by the expression of a soluble competitive inhibitor expressed from the inhibitor cell. Thus, 3-cell regulatory systems, with both positive and negative signaling, can be used to both control SynNotch expressing receiver cell activation. Therefore, spatial and conditional receiver cell modulation is not limited to positive signals and can be controlled using negative signals and combinations thereof.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (210 sequences)

SEQ ID NO: 1 - protein, 306 aa, Artificial sequence
  Synthetic polypeptide
PPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 2 - protein, 358 aa, Artificial sequence
  Synthetic polypeptide
PCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 3 - protein, 134 aa, Artificial sequence
  Synthetic polypeptide
GVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 4 - protein, 56 aa, Artificial sequence
  Synthetic polypeptide
IPYKIEAVKSEPVEPPLPSQLHLMYVAAAAFVLLFFVGCGVLLSRKRRRQLCIQKL

SEQ ID NO: 5 - protein, 120 aa, Artificial sequence
  Synthetic polypeptide
PPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDC

SEQ ID NO: 6 - protein, 152 aa, Artificial sequence
  Synthetic polypeptide
AAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLP

SEQ ID NO: 7 - protein, 23 aa, Artificial sequence
  Synthetic polypeptide
HLMYVAAAAFVLLFFVGCGVLLS

SEQ ID NO: 8 - protein, 37 aa, Artificial sequence
  Synthetic polypeptide
PCVGSNPCYNQGTCEPTSENPFYRCLCPAKFNGLLCH

SEQ ID NO: 9 - protein, 37 aa, Artificial sequence
  Synthetic polypeptide
DINECVLSPCRHGASCQNTHGGYRCHCQAGYSGRNCE

SEQ ID NO: 10 - protein, 37 aa, Artificial sequence
  Synthetic polypeptide
DIDDCRPNPCHNGGSCTDGINTAFCDCLPGFRGTFCE

SEQ ID NO: 11 - protein, 37 aa, Artificial sequence
  Synthetic polypeptide
DINECASDPCRNGANCTDCVDSYTCTCPAGFSGIHCE

SEQ ID NO: 12 - protein, 32 aa, Artificial sequence
  Synthetic polypeptide
TESSCFNGGTCVDGINSFTCLCPPGFTGSYCQ

SEQ ID NO: 13 - protein, 37 aa, Artificial sequence
  Synthetic polypeptide
DVNECDSQPCLHGGTCQDGCGSYRCTCPQGYTGPNCQ

SEQ ID NO: 14 - protein, 27 aa, Artificial sequence
  Synthetic polypeptide
DSSPCKNGGKCWQTHTQYRCECPSGWT

SEQ ID NO: 15 - protein, 36 aa, Artificial sequence
  Synthetic polypeptide
LVDECSPSPCQNGATCTDYLGGYSCKCVAGYHGVNC

SEQ ID NO: 16 - protein, 36 aa, Artificial sequence
  Synthetic polypeptide
IDECLSHPCQNGGTCLDLPNTYKCSCPRGTQGVHCE

SEQ ID NO: 17 - protein, 28 aa, Artificial sequence
  Synthetic polypeptide
CFNNGTCVDQVGGYSCTCPPGFVGERCE

SEQ ID NO: 18 - protein, 39 aa, Artificial sequence
  Synthetic polypeptide
DVNECLSNPCDARGTQNCVQRVNDFHCECRAGHTGRRCE

SEQ ID NO: 19 - protein, 10 aa, Artificial sequence
  Synthetic polypeptide
GRRRRELDPM

SEQ ID NO: 20 - protein, 9 aa, Artificial sequence
  Synthetic polypeptide
RQRRELDPM

SEQ ID NO: 21 - protein, 8 aa, Artificial sequence
  Synthetic polypeptide
KIEAVKSE

SEQ ID NO: 22 - protein, 8 aa, Artificial sequence
  Synthetic polypeptide
KIEAVQSE

SEQ ID NO: 23 - protein, 8 aa, Artificial sequence
  Synthetic polypeptide
VGCGVLLS

SEQ ID NO: 24 - protein, 7 aa, Artificial sequence
  Synthetic polypeptide
GCGVLLS

SEQ ID NO: 25 - protein, 21 aa, Artificial sequence
  Synthetic polypeptide
ESPYQELQGQRSDVYSDLNTQ

SEQ ID NO: 26 - protein, 21 aa, Artificial sequence
  Synthetic polypeptide
DGVYTGLSTRNQETYETLKHE

SEQ ID NO: 27 - protein, 112 aa, Artificial sequence
  Synthetic polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 28 - protein, 21 aa, Artificial sequence
  Synthetic polypeptide
NQLYNELNLGRREEYDVLDKR

SEQ ID NO: 29 - protein, 22 aa, Artificial sequence
  Synthetic polypeptide
EGLYNELQKDKMAEAYSEIGMK

SEQ ID NO: 30 - protein, 21 aa, Artificial sequence
  Synthetic polypeptide
DGLYQGLSTATKDTYDALHMQ

SEQ ID NO: 31 - protein, 113 aa, Artificial sequence
  Synthetic polypeptide
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 32 - protein, 112 aa, Artificial sequence
  Synthetic polypeptide
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 33 - protein, 102 aa, Artificial sequence
  Synthetic polypeptide
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 34 - protein, 101 aa, Artificial sequence
  Synthetic polypeptide
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 35 - protein, 86 aa, Artificial sequence
  Synthetic polypeptide
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 36 - protein, 171 aa, Artificial sequence
  Synthetic polypeptide
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 37 - protein, 127 aa, Artificial sequence
  Synthetic polypeptide
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 38 - protein, 21 aa, Artificial sequence
  Synthetic polypeptide
DQVYQPLRDRDDAQYSHLGGN

SEQ ID NO: 39 - protein, 207 aa, Artificial sequence
  Synthetic polypeptide
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 40 - protein, 21 aa, Artificial sequence
  Synthetic polypeptide
NPDYEPIRKGQRDLYSGLNQR

SEQ ID NO: 41 - protein, 182 aa, Artificial sequence
  Synthetic polypeptide
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 42 - protein, 21 aa, Artificial sequence
  Synthetic polypeptide
DQLYQPLKDREDDQYSHLQGN

SEQ ID NO: 43 - protein, 163 aa, Artificial sequence
  Synthetic polypeptide
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 44 - protein, 164 aa, Artificial sequence
  Synthetic polypeptide
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 45 - protein, 226 aa, Artificial sequence
  Synthetic polypeptide
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 46 - protein, 188 aa, Artificial sequence
  Synthetic polypeptide
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 47 - protein, 21 aa, Artificial sequence
  Synthetic polypeptide
ENLYEGLNLDDCSMYEDISRG

SEQ ID NO: 48 - protein, 20 aa, Artificial sequence
  Synthetic polypeptide
RPRRSPAQDGKVYINMPGRG

SEQ ID NO: 49 - protein, 68 aa, Artificial sequence
  Synthetic polypeptide
FWVLVVVGGVLACYSLLVTVAFIIFWVRSKRSRLLHSDYMNMTPRRPGPTRKHYQPYAPPRDFAAYRS

SEQ ID NO: 50 - protein, 619 aa, Artificial sequence
  Synthetic polypeptide
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 51 - protein, 44 aa, Artificial sequence
  Synthetic polypeptide
FWVRSKRSRLLHSDYMNMTPRRPGPTRKHYQPYAPPRDFAAYRS

SEQ ID NO: 52 - protein, 42 aa, Artificial sequence
  Synthetic polypeptide
KRGRKKLLYIFKQPFMRPVQTTQEEDGCSCRFPEEEEGGCEL

SEQ ID NO: 53 - protein, 37 aa, Artificial sequence
  Synthetic polypeptide
RRDQRLPPDAHKPPGGGSFRTPIQEEQADAHSTLAKI

SEQ ID NO: 54 - protein, 114 aa, Artificial sequence
  Synthetic polypeptide
CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 55 - protein, 49 aa, Artificial sequence
  Synthetic polypeptide
HQRRKYRSNKGESPVEPAEPCRYSCPREEEGSTIPIQEDYRKPEPACSP

SEQ ID NO: 56 - protein, 187 aa, Artificial sequence
  Synthetic polypeptide
RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 57 - protein, 54 aa, Artificial sequence
  Synthetic polypeptide
HIWQLRSQCMWPRETQLLLEVPPSTEDARSCQFPEEERGERSAEEKGRLGDLWV

SEQ ID NO: 58 - protein, 60 aa, Artificial sequence
  Synthetic polypeptide
CVKRRKPRGDVVKVIVSVQRKRQEAEGEATVIEALQAPPDVTTVAVEETIPSFTGRSPNH

SEQ ID NO: 59 - protein, 169 aa, Artificial sequence
  Synthetic polypeptide
MQIPQAPWPVVWAVLQLGWRPGWFLDSPDRPWNPPTFSPALLVVTEGDATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 60 - protein, 223 aa, Artificial sequence
  Synthetic polypeptide
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 61 - protein, 181 aa, Artificial sequence
  Synthetic polypeptide
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 62 - protein, 301 aa, Artificial sequence
  Synthetic polypeptide
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTLQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 63 - protein, 525 aa, Artificial sequence
  Synthetic polypeptide
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 64 - protein, 343 aa, Artificial sequence
  Synthetic polypeptide
VSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGD

SEQ ID NO: 65 - protein, 436 aa, Artificial sequence
  Synthetic polypeptide
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIGPVEQKLISEEDL

SEQ ID NO: 66 - protein, 125 aa, Artificial sequence
  Synthetic polypeptide
GNRSSHSRLGRIEADSESQEDIIRNIARHLAQVGDSMDRSIPPGLVNGLAEDRNRDLATALEQLLQAYPRDMEKEKTMLVLALLLAKKVASHTPSLLRDVFHTTVNFINQNLRTYVRSLARNGMD

SEQ ID NO: 67 - protein, 109 aa, Artificial sequence
  Synthetic polypeptide
VDALDDFDLDMLGSDALDDFDLDMLGSDALDDFDLDMLGSDALDDFDLDMLGSGGSGGSGGSLEIEAAFLERENTALETRVAELRQRVQRLRNRVSQYRTRYGPLGGGK

SEQ ID NO: 68 - protein, 205 aa, Artificial sequence
  Synthetic polypeptide
LEIRAAFLRQRNTALRTEVAELEQEVQRLENEVSQYETRYGPLGGGKGGSGGSGGSMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAA

SEQ ID NO: 69 - protein, 248 aa, Artificial sequence
  Synthetic polypeptide
MSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 70 - protein, 211 aa, Artificial sequence
  Synthetic polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 71 - protein, 535 aa, Artificial sequence
  Synthetic polypeptide
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 72 - protein, 318 aa, Artificial sequence
  Synthetic polypeptide
MELLSPPLRDIDLTGPDGSLCSFETADDFYDDPCFDSPDLRFFEDLDPRLVHMGALLKPEEHAHFPTAVHPGPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAFYAPGPLPPGRGSEHYSGDSDASSPRSNCSDGMMDYSGPPSGPRRQNGYDTAYYSEAARESRPGKSAAVSSLDCLSSIVERISTDSPAAPALLLADAPPESPPGPPEGASLSDTEQGTQTPSPDAAPQCPAGSNPNAIYQVL

SEQ ID NO: 73 - protein, 9 aa, Artificial sequence
  Synthetic polypeptide
YPYDVPDYA

SEQ ID NO: 74 - protein, 8 aa, Artificial sequence
  Synthetic polypeptide
DYKDDDDK

SEQ ID NO: 75 - protein, 10 aa, Artificial sequence
  Synthetic polypeptide
EQKLISEEDL

SEQ ID NO: 76 - protein, 5 aa, Artificial sequence
  Synthetic polypeptide
HHHHH

SEQ ID NO: 77 - protein, 6 aa, Artificial sequence
  Synthetic polypeptide
HHHHHH

SEQ ID NO: 78 - protein, 8 aa, Artificial sequence
  Synthetic polypeptide
WSHPQFEK

SEQ ID NO: 79 - protein, 5 aa, Artificial sequence
  Synthetic polypeptide
RYIRS

SEQ ID NO: 80 - protein, 4 aa, Artificial sequence
  Synthetic polypeptide
FHHT

SEQ ID NO: 81 - protein, 17 aa, Artificial sequence
  Synthetic polypeptide
WEAAAREACCRECCARA

SEQ ID NO: 82 - protein, 7 aa, Artificial sequence
  Synthetic polypeptide
PKKKRKV

SEQ ID NO: 83 - protein, 16 aa, Artificial sequence
  Synthetic polypeptide
KRPAATKKAGQAKKKK

SEQ ID NO: 84 - protein, 8 aa, Artificial sequence
  Synthetic polypeptide
MVPKKKRK

SEQ ID NO: 85 - protein, 17 aa, Artificial sequence
  Synthetic polypeptide
MAPKKKRKVGIHGVPAA

SEQ ID NO: 86 - protein, 4 aa, Artificial sequence
  Synthetic polypeptide
RQRR

SEQ ID NO: 87 - protein, 4 aa, Artificial sequence
  Synthetic polypeptide
VLLS

SEQ ID NO: 88 - protein, 206 aa, Artificial sequence
  Synthetic polypeptide
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPG

SEQ ID NO: 89 - protein, 273 aa, Artificial sequence
  Synthetic polypeptide
RPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 90 - protein, 242 aa, Artificial sequence
  Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 91 - protein, 244 aa, Artificial sequence
  Synthetic polypeptide
GSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKAS

SEQ ID NO: 92 - protein, 261 aa, Artificial sequence
  Synthetic polypeptide
GSQVQLQQQVQLQESGGDLVKPGGSLKLSCAASGFTFSHYGMSWVRQTPDKRLEWVATIGSRGTYTHYPDSVKGRFTISRDNDKNALYLQMNSLKSEDTAMYYCARRSEFYYYGNTYYYSAMDYWGQGASVTVSSGGGGSGGGGSGGGGSDIVLTQSPAFLAVSLGQRATISCRASESVDNYGFSFMNWFQQKPGQPPKLLIYAISNRGSGVPARFSGSGSGTDFSLNIHPVEEDDPAMYFCQQTKEVPWTFGGGTKLEIK

SEQ ID NO: 93 - protein, 127 aa, Artificial sequence
  Synthetic polypeptide
MADVQLVESGGGLVQAGGSLRLSCAASGRTFSTSAMGWFRQAPGKEREFVARITWSAGYTAYSDSVKGRFTISRDKAKNTVYLQMNSLKPEDTAVYYCASRSAGYSSSLTRREDYAYWGQGTQVTVS

SEQ ID NO: 94 - protein, 128 aa, Artificial sequence
  Synthetic polypeptide
MADVQLVESGGGLVQAGGSLRLSCAASGRTISMAAMSWFRQAPGKEREFVAGISRSAGSAVHADSVKGRFTISRDNTKNTLYLQMNSLKAEDTAVYYCAVRTSGFFGSIPRTGTAFDYWGQGTQVTVS

SEQ ID NO: 95 - protein, 128 aa, Artificial sequence
  Synthetic polypeptide
MAQVQLVESGGGLVQTGGSLKLSCTASVRTLSYYHVGWFRQAPGKEREFVAGIHRSGESTFYADSVKGRFTISRDNAKNTVHLQMNSLKPEDTAVYYCAQRVRGFFGPLRSTPSWYDYWGQGTQVTVS

SEQ ID NO: 96 - protein, 270 aa, Artificial sequence
  Synthetic polypeptide
MAQVQLVESGGRLVQAGDSLRLSCAASGRTFSTSAMAWFRQAPGREREFVAAITWTVGNTILGDSVKGRFTISRDRAKNTVDLQMDNLEPEDTAVYYCSARSRGYVLSVLRSVDSYDYWGQGTQVTVSGGGGSGGGGSGGGGSMAQVQLVESGGGLVQAGGSLRLSCAASGRTFSNYAMGWFRQAPGKEREFVAAISWTGVSTYYADSVKGRFTISRDNDKNTVYVQMNSLIPEDTAIYYCAAVRARSFSDTYSRVNEYDYWGQGTQVTV

SEQ ID NO: 97 - protein, 176 aa, Artificial sequence
  Synthetic polypeptide
MQIPQAPWPVVWAVLQLGWRPGWFLDSPDRPWNPPTFSPALLVVTEGDATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQEQKLISEEDL

SEQ ID NO: 98 - protein, 185 aa, Artificial sequence
  Synthetic polypeptide
GSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYD

SEQ ID NO: 99 - protein, 115 aa, Artificial sequence
  Synthetic polypeptide
PKKKRKVDALDDFDLDMLGSDALDDFDLDMLGSDALDDFDLDMLGSDALDDFDLDMLGSGGSGGSGGSLEIEAAFLERENTALETRVAELRQRVQRLRNRVSQYRTRYGPLGGGK

SEQ ID NO: 100 - protein, 351 aa, Artificial sequence
  Synthetic polypeptide
MVPKKKRKVSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGD

SEQ ID NO: 101 - protein, 6 aa, Artificial sequence
  Synthetic polypeptide
  MISC_FEATURE (2)..(2): Xaa can be Leu or Gln.
PXGMTS

SEQ ID NO: 102 - protein, 5 aa, Artificial sequence
  Synthetic polypeptide
  MISC_FEATURE (2)..(2): Xaa can be Leu or Gln.
PXGMT

SEQ ID NO: 103 - protein, 7 aa, Artificial sequence
  Synthetic polypeptide
ENLYTQS

SEQ ID NO: 104 - protein, 5 aa, Artificial sequence
  Synthetic polypeptide
DDDDK

SEQ ID NO: 105 - protein, 4 aa, Artificial sequence
  Synthetic polypeptide
LVPR

SEQ ID NO: 106 - protein, 8 aa, Artificial sequence
  Synthetic polypeptide
LEVLFQGP

SEQ ID NO: 107 - protein, 10 aa, Artificial sequence
  Synthetic polypeptide
CGLVPAGSGP

SEQ ID NO: 108 - protein, 12 aa, Artificial sequence
  Synthetic polypeptide
SLLKSRMVPNFN

SEQ ID NO: 109 - protein, 12 aa, Artificial sequence
  Synthetic polypeptide
SLLIARRMPNFN

SEQ ID NO: 110 - protein, 12 aa, Artificial sequence
  Synthetic polypeptide
SKLVQASASGVN

SEQ ID NO: 111 - protein, 12 aa, Artificial sequence
  Synthetic polypeptide
SSYLKASDAPDN

SEQ ID NO: 112 - protein, 12 aa, Artificial sequence
  Synthetic polypeptide
RPKPQQFFGLMN

SEQ ID NO: 113 - protein, 12 aa, Artificial sequence
  Synthetic polypeptide
SLRPLALWRSFN

SEQ ID NO: 114 - protein, 12 aa, Artificial sequence
  Synthetic polypeptide
SPQGIAGQRNFN

SEQ ID NO: 115 - protein, 14 aa, Artificial sequence
  Synthetic polypeptide
DVDERDVRGFASFL

SEQ ID NO: 116 - protein, 12 aa, Artificial sequence
  Synthetic polypeptide
SLPLGLWAPNFN

SEQ ID NO: 117 - protein, 12 aa, Artificial sequence
  Synthetic polypeptide
SLLIFRSWANFN

SEQ ID NO: 118 - protein, 12 aa, Artificial sequence
  Synthetic polypeptide
SGVVIATVIVIT

SEQ ID NO: 119 - protein, 12 aa, Artificial sequence
  Synthetic polypeptide
SLGPQGIWGQFN

SEQ ID NO: 120 - protein, 12 aa, Artificial sequence
  Synthetic polypeptide
KKSPGRVVGGSV

SEQ ID NO: 121 - protein, 12 aa, Artificial sequence
  Synthetic polypeptide
PQGLLGAPGILG

SEQ ID NO: 122 - protein, 31 aa, Artificial sequence
  Synthetic polypeptide
HGPEGLRVGFYESDVMGRGHARLVHVEEPHT

SEQ ID NO: 123 - protein, 12 aa, Artificial sequence
  Synthetic polypeptide
GPQGLAGQRGIV

SEQ ID NO: 124 - protein, 12 aa, Artificial sequence
  Synthetic polypeptide
GGSGQRGRKALE

SEQ ID NO: 125 - protein, 12 aa, Artificial sequence
  Synthetic polypeptide
SLSALLSSDIFN

SEQ ID NO: 126 - protein, 12 aa, Artificial sequence
  Synthetic polypeptide
SLPRFKIIGGFN

SEQ ID NO: 127 - protein, 12 aa, Artificial sequence
  Synthetic polypeptide
SLLGIAVPGNFN

SEQ ID NO: 128 - protein, 12 aa, Artificial sequence
  Synthetic polypeptide
FFKNIVTPRTPP

SEQ ID NO: 129 - protein, 21 aa, Artificial sequence
  Synthetic polypeptide
MALPVTALLLPLALLLHAARP

SEQ ID NO: 130 - DNA, 20 bp, Artificial sequence
  Synthetic polynucleotide
ggagcactgtcctccgaacg

SEQ ID NO: 131 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 132 - protein, 2531 aa, Mus musculus
MPRLLTPLLCLTLLPALAARGLRCSQPSGTCLNGGRCEVANGTEACVCSGAFVGQRCQDSNPCLSTPCKNAGTCHVVDHGGTVDYACSCPLGFSGPLCLTPLDNACLANPCRNGGTCDLLTLTEYKCRCPPGWSGKSCQQADPCASNPCANGGQCLPFESSYICRCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNGGTCHNTHGGYNCVCVNGWTGEDCSENIDDCASAACFQGATCHDRVASFYCECPHGRTGLLCHLNDACISNPCNEGSNCDTNPVNGKAICTCPSGYTGPACSQDVDECALGANPCEHAGKCLNTLGSFECQCLQGYTGPRCEIDVNECISNPCQNDATCLDQIGEFQCICMPGYEGVYCEINTDECASSPCLHNGHCMDKINEFQCQCPKGFNGHLCQYDVDECASTPCKNGAKCLDGPNTYTCVCTEGYTGTHCEVDIDECDPDPCHYGSCKDGVATFTCLCQPGYTGHHCETNINECHSQPCRHGGTCQDRDNSYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEVDINECVKSPCRHGASCQNTNGSYRCLCQAGYTGRNCESDIDDCRPNPCHNGGSCTDGINTAFCDCLPGFQGAFCEEDINECASNPCQNGANCTDCVDSYTCTCPVGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGRCWQTNTQYHCECRSGWTGVNCDVLSVSCEVAAQKRGIDVTLLCQHGGLCVDEGDKHYCHCQAGYTGSYCEDEVDECSPNPCQNGATCTDYLGGFSCKCVAGYHGSNCSEEINECLSQPCQNGGTCIDLTNSYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCKNGGVCAVASNTARGFICRCPAGFEGATCENDARTCGSLRCLNGGTCISGPRSPTCLCLGSFTGPECQFPASSPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLSDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACGSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHSMMGPLHSSLSTNTLSPIIYQGLPNTRLATQPHLVQTQQVQPQNLQLQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSPHSNISDWSEGISSPPTTMPSQITHIPEAFK

SEQ ID NO: 133 - protein, 1429 aa, Caenorhabditis elegans
MRIPTICFLFLLISLSKSLHIGSCLGLICGRNGHCHAGPVNGTQTSYWCRCDEGFGGEYCEQQCDVSKCGADEKCVFDKDYRMETCVCKDCDINGNSLLKPSCPSGYGGDDCKTQGWCYPSVCMNGGQCIGAGNRAKCACPDGFKGERCELDVNECEENKNACGNRSTCMNTLGTYICVCPQGFLPPDCLKPGNTSTVEFKQPVCFLEISADHPDGRSMYCQNGGFCDKASSKCQCPPGYHGSTCELLEKEDSCASNPCSHGVCISFSGGFQCICDDGYSGSYCQEGKDNCVNNKCEAGSKCINGVNSYFCDCPPERTGPYCEKMDCSAIPDICNHGTCIDSPLSEKAFECQCEPGYEGILCEQDKNECLSENMCLNNGTCVNLPGSFRCDCARGFGGKWCDEPLNMCQDFHCENDGTCMHTSDHSPVCQCKNGFIGKRCEKECPIGFGGVRCDLRLEIGICSRQGGKCFNGGKCLSGFCVCPPDFTGNQCEVNRKNGKSSLSENLCLSDPCMNNATCIDVDAHIGYACICKQGFEGDICERHKDLCLENPCSNGGVCHQHRESFSCDCPPGFYGNGCEQEKMFRCLKSTCQNGGVCINEEEKGRKCECSYGFSGARCEEKINLTGFTEKDSLLRSVCEKRKCSERANDGNCDADCNYAACKFDGGDCSGKREPFSKCRYGNMCADFFANGVCNQACNNEECLYDGMDCLPAVVRCPVKIREHCASRFANGICDPECNTNGCGFDGGDCDNETNATIITNIRITVQMDPKEFQVTGGQSLMEISSALRVTVRIQRDEEGPLVFQWNGESEMDRVKMNERQLTEQHVLSTSISRKIKRSATNIGVVVYLEVQENCDTGKCLYKDAQSVVDSISARLAKKGIDSFGIPISEALVAEPRKSGNNTGFLSWNALLLIGAGCLIVMVVLMLGALPGNRTRKRRMINASVWMPPMENEEKNRKNHQSITSSQHSLLEASYDGYIKRQRNELQHYSLYPNPQGYGNGNDFLGDFNHTNLQIPTEPEPESPIKLHTEAAGSYAITEPITRESVNIIDPRHNRTVLHWIASNSSAEKSEDLIVHEAKECIAAGADVNAMDCDENTPLMLAVLARRRRLVAYLMKAGADPTIYNKSERSALHQAAANRDFGMMVYMLNSTKLKGDIEELDRNGMTALMIVAHNEGRDQVASAKLLVEKGAKVDYDGAARKDSEKYKGRTALHYAAQVSNMPIVKYLVGEKGSNKDKQDEDGKTPIMLAAQEGRIEVVMYLIQQGASVEAVDATDHTARQLAQANNHHNIVDIFDRCRPEREYSMDLHIQHTHQPQPSRKVTRAPKKQTSRSKKESASNSRDSTHLTPPPSDGSTSTPSPQHFMNTTHTTPTSLNYLSPEYQTEAGSSEAFQPQCGAFGNGEMWYTRASTSYTQMQNEPMTRYSEPAHYF

SEQ ID NO: 134 - protein, 2703 aa, Drosophila melanogaster
MQSQRSRRRSRAPNTWICFWINKMHAVASLPASLPLLLLTLAFANLPNTVRGTDTALVAASCTSVGCQNGGTCVTQLNGKTYCACDSHYVGDYCEHRNPCNSMRCQNGGTCQVTFRNGRPGISCKCPLGFDESLCEIAVPNACDHVTCLNGGTCQLKTLEEYTCACANGYTGERCETKNLCASSPCRNGATCTALAGSSSFTCSCPPGFTGDTCSYDIEECQSNPCKYGGTCVNTHGSYQCMCPTGYTGKDCDTKYKPCSPSPCQNGGICRSNGLSYECKCPKGFEGKNCEQNYDDCLGHLCQNGGTCIDGISDYTCRCPPNFTGRFCQDDVDECAQRDHPVCQNGATCTNTHGSYSCICVNGWAGLDCSNNTDDCKQAACFYGATCIDGVGSFYCQCTKGKTGLLCHLDDACTSNPCHADAICDTSPINGSYACSCATGYKGVDCSEDIDECDQGSPCEHNGICVNTPGSYRCNCSQGFTGPRCETNINECESHPCQNEGSCLDDPGTFRCVCMPGFTGTQCEIDIDECQSNPCLNDGTCHDKINGFKCSCALGFTGARCQINIDDCQSQPCRNRGICHDSIAGYSCECPPGYTGTSCEININDCDSNPCHRGKCIDDVNSFKCLCDPGYTGYICQKQINECESNPCQFDGHCQDRVGSYYCQCQAGTSGKNCEVNVNECHSNPCNNGATCIDGINSYKCQCVPGFTGQHCEKNVDECISSPCANNGVCIDQVNGYKCECPRGFYDAHCLSDVDECASNPCVNEGRCEDGINEFICHCPPGYTGKRCELDIDECSSNPCQHGGTCYDKLNAFSCQCMPGYTGQKCETNIDDCVTNPCGNGGTCIDKVNGYKCVCKVPFTGRDCESKMDPCASNRCKNEAKCTPSSNFLDFSCTCKLGYTGRYCDEDIDECSLSSPCRNGASCLNVPGSYRCLCTKGYEGRDCAINTDDCASFPCQNGGTCLDGIGDYSCLCVDGFDGKHCETDINECLSQPCQNGATCSQYVNSYTCTCPLGFSGINCQTNDEDCTESSCLNGGSCIDGINGYNCSCLAGYSGANCQYKLNKCDSNPCLNGATCHEQNNEYTCHCPSGFTGKQCSEYVDWCGQSPCENGATCSQMKHQFSCKCSAGWTGKLCDVQTISCQDAADRKGLSLRQLCNNGTCKDYGNSHVCYCSQGYAGSYCQKEIDECQSQPCQNGGTCRDLIGAYECQCRQGFQGQNCELNIDDCAPNPCQNGGTCHDRVMNFSCSCPPGTMGIICEINKDDCKPGACHNNGSCIDRVGGFECVCQPGFVGARCEGDINECLSNPCSNAGTLDCVQLVNNYHCNCRPGHMGRHCEHKVDFCAQSPCQNGGNCNIRQSGHHCICNNGFYGKNCELSGQDCDSNPCRVGNCVVADEGFGYRCECPRGTLGEHCEIDTLDECSPNPCAQGAACEDLLGDYECLCPSKWKGKRCDIYDANYPGWNGGSGSGNDRYAADLEQQRAMCDKRGCTEKQGNGICDSDCNTYACNFDGNDCSLGINPWANCTANECWNKFKNGKCNEECNNAACHYDGHDCERKLKSCDSLFDAYCQKHYGDGFCDYGCNNAECSWDGLDCENKTQSPVLAEGAMSVVMLMNVEAFREIQAQFLRNMSHMLRTTVRLKKDALGHDIIINWKDNVRVPEIEDTDFARKNKILYTQQVHQTGIQIYLEIDNRKCTECFTHAVEAAEFLAATAAKHQLRNDFQIHSVRGIKNPGDEDNGEPPANVKYVITGIILVIIALAFFGMVLSTQRKRAHGVTWFPEGFRAPAAVMSRRRRDPHGQEMRNLNKQVAMQSQGVGQPGAHWSDDESDMPLPKRQRSDPVSGVGLGNNGGYASDHTMVSEYEEADQRVWSQAHLDVVDVRAIMTPPAHQDGGKHDVDARGPCGLTPLMIAAVRGGGLDTGEDIENNEDSTAQVISDLLAQGAELNATMDKTGETSLHLAARFARADAAKRLLDAGADANCQDNTGRTPLHAAVAADAMGVFQILLRNRATNLNARMHDGTTPLILAARLAIEGMVEDLITADADINAADNSGKTALHWAAAVNNTEAVNILLMHHANRDAQDDKDETPLFLAAREGSYEACKALLDNFANREITDHMDRLPRDVASERLHHDIVRLLDEHVPRSPQMLSMTPQAMIGSPPPGQQQPQLITQPTVISAGNGGNNGNGNASGKQSNQTAKQKAAKKAKLIEGSPDNGLDATGSLRRKASSKKTSAASKKAANLNGLNPGQLTGGVSGVPGVPPTNSAAQAAAAAAAAVAAMSHELEGSPVGVGMGGNLPSPYDTSSMYSNAMAAPLANGNPNTGAKQPPSYEDCIKNAQSMQSLQGNGLDMIKLDNYAYSMGSPFQQELLNGQGLGMNGNGQRNGVGPGVLPGGLCGMGGLSGAGNGNSHEQGLSPPYSNQSPPHSVQSSLALSPHAYLGSPSPAKSRPSLPTSPTHIQAMRHATQQKQFGGSNLNSLLGGANGGGVVGGGGGGGGGVGQGPQNSPVSLGIISPTGSDMGIMLAPPQSSKNSAIMQTISPQQQQQQQQQQQQQHQQQQQQQQQQQQQQQQQLGGLEFGSAGLDLNGFCGSPDSFHSGQMNPPSIQSSMSGSSPSTNMLSPSSQHNQQAFYQYLTPSSQHSGGHTPQHLVQTLDSYPTPSPESPGHWSSSSPRSNSDWSEGVQSPAANNLYISGGHQANKGSEAIYI

SEQ ID NO: 135 - protein, 2900 aa, Bos taurus
MTPVCTPTRPGPCAHPALPRSTPHSITDSSRAEPIESFLVLSPALELRLLLAVVGQDTPLGDVWAGGKASGGGDTEGPLSEGSKEGEAATGPQAPGAEWHAPPRSTCLSSTPRPEAVPPSLPCRSPGWGACGGRRPGPALEPAHMGSVPSQQRPPGLDRSREDNGPPQPLPSPHGGASLAPAPPPACRGWQPPLRWPGAAAARVPGHRRTCSPAALCPCCRCLIYWARFSSHCNSRSLPGQDALGPGLWVPSATQAGTRQPVTGSTLSGGHATFPRLQGMALPEPEGEGPPTTSAQGCGPSVRAAFPGRCQLGAVGAFHPRGSAAGKREAWLVPEPLLGFPSSSRLRGDPGGHVPPRLKKPRQQVAKGGPGAGVAGAEPFPVGSAGDQAWGWAGGKAPPTPGSPATVAAREPAQGLPDCGGAFAGQQCQAPNPCLSAPCKNGGTCHTTEREGLVDYVCGCRLGFSGPLCLTPRDHACLASPCLNGGTCDLLTLTEYKCLCTPGWSGKTCQQADPCASNPCANGGQCLPFEASYICHCPPGFHGPTCRQDVNECSQSPGLCHHGGTCLNEVGSYRCVCRPTHTGPHCELPYVPCSPSPCQNGGTCRPTGDTTHECACLPGFTGQNCEENIDDCPGNSCKNGGACVDGVNTYNCRCPPEWTGQYCTEDVDECQLMPNACQNGGTCHNTHGGYNCVCVNGWTGEDCSENIDDCASASCFQGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGLHCEVNTDECASSPCLQNGRCLDKINEFVCECPTGFTGHLCQYDVDECASTPCKNGAKCLDGPNTYTCVCTEGYTGPHCEVDIDECDPDPCHYGSCKDGVATFTCLCQPGYTGHHCESNINECHSQPCRHGGTCQDRDNAYLCFCLKGTTGPNCEINLDDCASNPCDSGTCLDKIDGYECACEPGYTGSMCNINIDECADSPCHNGGTCEDGINGFTCRCPEGYHDPTCLSEVNECSSNPCIHGACRDSLNGYKCDCDPGWSGANCDVNNDECESNPCINGGTCKDMTSGYVCACREGFSGPNCQTNINECASNPCLNQGTCIDDVAGYKCNCLLPYTGATCEVVLAPCAPGPCRNGGECRESEDYESFSCACPAGWQGQTCEIDINECVKSPCRAGASCQNTNGSYRCHCQAGYTGRNCETDIDDCRPNPCHNGGSCTDGINTAFCDCLPGFQGAFCEEDINECASSPCRNGANCTDCVDSYTCTCPTGFSGIHCENNTPDCTESSCFNGGTCVDGINSFTCLCPPGFTGSYCQHDVNECDSRPCLHGGTCHDSYGTYTCTCPQGYTGLNCQTLVRWCDSSPCKNDGRCWQTNALYRCECHSGWTGLYCDVPSVSCEVAARQQGVNVTHLCRNGGLCMNAGNTHRCHCQAGYTGSYCEEQVDECSPSPCQNGATCTDYPGGYSCECVAGYHGVNCSEEVNECLSQPCRNGGTCIDLTNTYKCSCPRGTQGVHCEINVDDCNPPIDPVSRGPKCFNNGTCVDQVGGYSCSCPPGFVGERCEGDVNECLSNPCDARGTQNCVQHVNAFHCECRAGHTGRRCESVINGCKDRPCKNGGSCAVASNTARGFICKCPAGFEGATCENDARSCGSLRCLNGGTCIAGPRSPTCLCLGPFTGPECQFPASSPCVGGNPCYNQGVCEPTAESPFYRCRCPAKFNGLLCHILDYSFGGGVGLDIPPPQIEETCELPGCREEAGNKVCSLQCNSHACGWDGGDCSLDFDDPWQNCTQSLQCWKYFSNGRCDSQCNSAGCLFDGFDCQRAEGQCNPLYDQYCKDHFRDGHCDQGCNSAECEWDGLDCAEHVPERLAAGTLVLVVLMPPEQLRNRSLHFLRELSRLLHTNVVFKRDASGQQMIFPYYGRAPLPAGERSEECRCEHHACPAGAGQGEPSGPLCTSRSIVYLEIDNRQCVQSSSQCFQSATDVAAFLGALASLGSLNIPYKIEAVQSETVEPPPPPPLHFMYVAVVAFVLLFFVGCGVLLSRKRRRQHGQLWFPEGFKVSEASKKKRREPLGEDSVGLKPLKNSSDGALMDDNQNEWGDEGLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPPLHGATLGGTPTLSPPLCSPNGYLGNLKPPMQGKKARKPSTKGLACGGKEPKDLKARRKKSQDGKGCLLDSGSVMSPVDSLESPHGYLSDVASPPLLPSPFQPSPSVPLNHLPGMPETHLGVSHLSVAAKPEMAVLSGGSRLAFEAGPPRLSHLPVASSTSTILGSGGSGGSGAVNFTVGGAAGLNGQCEWLSRLQNGLVPNQYNPLRGGVTPGTLSTQAAGLQHGTVGPLHAPALSQVMTYQALPSTRLASQPHLVQPQQNLQMQPPSMPPQPNLQPHLGVSSAASGHLGRSFLGGELSQADMQPLGPGNLAAHTVLPQDGQVLPTSLPSTLAPPTMAPPMTTAQFLTPPSQHSYSSSPVDNTPSHQLQVPEHPFLTPSPESPDQWSSSSPHSNISDWSEGISSPPTSVPSQIAHVPEAFK

SEQ ID NO: 136 - protein, 2561 aa, Gallus gallus
MGRCSAAHPRGGVHCPGLCAVPDALLLFPGVRCTQLAESCLNGGKCETFLNGTEVCQCSSAHMGERCQLPNPCLSSPCKNAGTCIPLLRGSTADYTCVCRLGFTDELCLTPLDNACLNNPCRNGGTCDLVTLSEYKCRCPPGWSGKTCQQADPCASNPCANGGQCVPFEAHYICRCTAGFHGANCKQDVNECNISPPVCKNGGSCTNEVGTYQCSCKPAYTGQNCEHLYVPCNPSPCQNGGTCRQTGDTTYDCTCLPGFTGQNCEENIDDCPGNNCRNGGTCVDGVNTYNCQCPPEWTGQYCTEDVDECQLMPNACQNGGTCHNNHGGYNCVCVNGWTGEDCSENIDDCAMAACFQGATCHDRVASFYCECPHGRTGLLCHLDDACISNPCNEGSNCDTNPVNGKAICTCPSGYMGPACNQDVDECSLGANPCEHAGKCINTQGSFQCQCLQGYSGPRCEIDVNECLSNPCQNDATCLDQIGEFQCICMPGYEGVYCEINTDECASSPCLHNGNCLDKINEFHCECPTGFNGHLCQFDIDECASTPCKNGAKCVDGPNTYSCECTEGFSGVHCEIDIDECNPDPCHYGTCKDSIAAFTCLCQPGYTGHRCDININECQSQPCRNGGTCQDRDNAYNCLCLKGTTGPNCEINLDDCASNPCDYGKCIDKINGYECTCEPGYTGRMCNINIDECASNPCHNGGTCKDGINGFTCLCPEGFHDPKCLSEVNECNSNPCIHGRCHDGLNGYRCDCDPGWSGTNCDINNNECESNPCMNGGTCKDMTSGYICTCREGFSGPNCQTNINECASNPCLNQGTCIDDVAGYTCNCLLPYTGATCEDVLAPCAGGPCKNGGECRESEDYKRFSCSCPPGWQGQTCEIDINECVKSPCRNGATCQNTNGSYRCLCRVGFAGRNCDTDIDDCQPNPCHNGGSCSDGIGTFFCECLAGFRGLKCEEDINECASNPCKNGANCTDCVNSYTCTCPSGFSGIHCENNTPDCTESSCFNGGTCVDGINTFTCLCPSGFTGSYCEHNINECDSKPCLNGGTCQDSYGTYKCTCPQGYTGLNCQNLVRWCDSSPCKNGGKCWQTNNLYRCECNSGWTGLYCDVPSVSCEVAAKQQGIDVAHLCRNSGLCVDSGNTHFCRCQAGYTGSYCEEQVDECSPNPCQNGATCTDYLGGYSCECVAGYHGVNCSEEINECLSHPCQNGGTCIDLINTYKCSCPRGTQGVHCEINVDDCSPFFDPVTLGPKCFNNGKCTDRVGGYSCICPPGFVGERCEGDVNECLSNPCDARGTQNCVQRVNDYKCECRPGYAGRRCDTVVDGCKGKPCRNGGTCAVASNTGRGFICKCPPGFVGATCENDSHTCGTLHCLNGGTCISMHKSSKCVCAAAFTGPECQYPASSPCISNPCYNGGTCEFLSDASPYYHCNCPANFNGLNCHILDFDFQGGFGQDIIPPKIEEKCEIAVCASYAGNKICDGKCNNHACGWDGGDCSLNFNDPWKNCSQSLQCWKYFNDGKCDSQCNNAGCLYDGFDCQKYEGQCNPLYDQYCKDHFSDGHCDQGCNNFECEWDGLDCANNMPEKLADGTLVVVVLITPENLKNNSFNFLRELSRVLHTNVVFKKNAKGEYMIFPYYGNEEELKKHYIKRSTEDWADMSSAVINKVKSSLYSRAGRRQKRELDQMDIRGSIVYLEIDNRQCIQSSSQCFQSATDVAAFLGALASLGNLNIPYKIEAVKSETAEPARNSQLYPMYVVVAALVLLAFIGVGVLVSRKRRREHGQLWFPEGFKVTESSKKKRREPLGEDSVGLKPLKNASDGTLMDDNQNEWGDEETLDTKKFRFEEQAMLPDTDDQTDHRQWTQQHLDAADLRISSMAPTPPQGEIDADCMDVNVRGPDGFTPLMIASCSGGGLETGNSEEEDDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINCHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYNLVRSPPLHSGPLGAPTLSPPLCSPSSYIGNLKPAVQGKKARKPSTKGLSCNGKDSKDLKARRKKSQDGKGCLLDNSSVLSPVDSLESPHGYLSDVASPPLMTSPFQQSPSMPLNHLPGMPDAHMSINHLNMAGKQEMALGGSGRMAFEAVPPRLSHLPVSSPSTAMSNAPMNFSVGGAAGLSGQCDWLSRLQSGMVQNQYGAMRGGMQPGTHQQAQNLQHGMMSSLHNGLPSTSLSQMMSYQAMPSTRLASQPHLLQNQQMQQMQQPGMQPQPGMQPQPGMQQPQQQPQQQPQPQQHHNPGSNASGHMGQNFLGTELSQPDMQPVSSSAMAVHTILPQDSQLLPTSLPSSLAQPMTTTQFLTPPSQHSYSSPLDNTPSHQLQVPDHPFLTPSPESPDQWSSSSPHSNVSDWSEGISSPPTSMQSQMGHIPEAFK

SEQ ID NO: 137 - protein, 2531 aa, Rattus norvegicus
MPRLLAPLLCLTLLPALAARGLRCSQPSGTCLNGGRCEVANGTEACVCSGAFVGQRCQDPSPCLSTPCKNAGTCYVVDHGGIVDYACSCPLGFSGPLCLTPLANACLANPCRNGGTCDLLTLTEYKCRCPPGWSGKSCQQADPCASNPCANGGQCLPFESSYICGCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNAGTCHNSHGGYNCVCVNGWTGEDCSDNIDDCASAACFQGATCHDRVASFYCECPHGRTGLLCHLNDACISNPCNEGSNCDTNPVNGKAICTCPRGYTGPACSQDVDECALGANPCEHAGKCLNTLGSFECQCLQGYTGPRCEIDVNECISNPCQNDATCLDQIGEFQCICMPGYEGVYCEINTDECASSPCLHNGRCVDKINEFLCQCPKGFSGHLCQYDVDECASTPCKNGAKCLDGPNTYTCVCTEGYTGTHCEVDIDECDPDPCHIGLCKDGVATFTCLCQPGYTGHHCETNINECHSQPCRHGGTCQDRDNYYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEIDINECVKSPCRHGASCQNTNGSYRCLCQAGYTGRNCESDIDDCRPNPCHNGGSCTDGVNAAFCDCLPGFQGAFCEEDINECATNPCQNGANCTDCVDSYTCTCPTGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGKCWQTNTQYHCECRSGWTGFNCDVLSVSCEVAAQKRGIDVTLLCQHGGLCVDEEDKHYCHCQAGYTGSYCEDEVDECSPNPCQNGATCTDYLGGFSCKCVAGYHGSNCSEEINECLSQPCQNGGTCIDLTNTYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCRNGGVCAVASNTARGFICRCPARFEGATCENDARTCGSLRCLNGGTCISGPRSPTCLCLGSFTGPECQFPASSPCVGSNPCYNQGTCEPTSESPFYRCLCPAKFNGLLCHILDYSFTGAAGRDIPPPQIEEACELPECQEDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRDVSHVLHTNVVFKRDAQGQQMIFPYYGREEELRKHPIKRSAVGWATTSLLPGTNGGRQRRELDPMDIHGSIVYLEIDNRQCVQSSSQCFQSATDVAAFLGALASLGSLNIPYKIEAVKSETVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRVSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACSSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHGMMGPIHSSLSTNTLSPIIYQGLPNTRLATQPHLVQTQQVQPQNLQIQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSRHSNISDWSEGISSPPTSMPSQITHIPEAFK

SEQ ID NO: 138 - protein, 370 aa, Mus musculus
PECQFPASSPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKR

SEQ ID NO: 139 - protein, 380 aa, Homo sapiens
PECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKR

SEQ ID NO: 140 - protein, 365 aa, Bos taurus
PECQFPASSPCVGGNPCYNQGVCEPTAESPFYRCRCPAKFNGLLCHILDYSFGGGVGLDIPPPQIEETCELPGCREEAGNKVCSLQCNSHACGWDGGDCSLDFDDPWQNCTQSLQCWKYFSNGRCDSQCNSAGCLFDGFDCQRAEGQCNPLYDQYCKDHFRDGHCDQGCNSAECEWDGLDCAEHVPERLAAGTLVLVVLMPPEQLRNRSLHFLRELSRLLHTNVVFKRDASGQQMIFPYYGRAPLPAGERSEECRCEHHACPAGAGQGEPSGPLCTSRSIVYLEIDNRQCVQSSSQCFQSATDVAAFLGALASLGSLNIPYKIEAVQSETVEPPPPPPLHFMYVAVVAFVLLFFVGCGVLLSRKR

SEQ ID NO: 141 - protein, 333 aa, Artificial sequence
  Synthetic polypeptide
ILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKL

SEQ ID NO: 142 - protein, 370 aa, Artificial sequence
  Synthetic polypeptide
PCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKL

SEQ ID NO: 143 - protein, 787 aa, Artificial sequence
  Synthetic polypeptide
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 144 - protein, 889 aa, Artificial sequence
  Synthetic polypeptide
METDTLLLWVLLLWVPGSTGDYPYDVPDYAGAQPARPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 145 - protein, 854 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 146 - protein, 891 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 147 - protein, 891 aa, Artificial sequence
  Synthetic polypeptide
MALPVTALLLPLALLLHAARPDYKDDDDKGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 148 - protein, 871 aa, Artificial sequence
  Synthetic polypeptide
MALPVTALLLPLALLLHAARPDYKDDDDKGSQVQLQQQVQLQESGGDLVKPGGSLKLSCAASGFTFSHYGMSWVRQTPDKRLEWVATIGSRGTYTHYPDSVKGRFTISRDNDKNALYLQMNSLKSEDTAMYYCARRSEFYYYGNTYYYSAMDYWGQGASVTVSSGGGGSGGGGSGGGGSDIVLTQSPAFLAVSLGQRATISCRASESVDNYGFSFMNWFQQKPGQPPKLLIYAISNRGSGVPARFSGSGSGTDFSLNIHPVEEDDPAMYFCQQTKEVPWTFGGGTKLEIKILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 149 - protein, 873 aa, Artificial sequence
  Synthetic polypeptide
MALPVTALLLPLALLLHAARPEQKLISEEDLGSQVQLQQQVQLQESGGDLVKPGGSLKLSCAASGFTFSHYGMSWVRQTPDKRLEWVATIGSRGTYTHYPDSVKGRFTISRDNDKNALYLQMNSLKSEDTAMYYCARRSEFYYYGNTYYYSAMDYWGQGASVTVSSGGGGSGGGGSGGGGSDIVLTQSPAFLAVSLGQRATISCRASESVDNYGFSFMNWFQQKPGQPPKLLIYAISNRGSGVPARFSGSGSGTDFSLNIHPVEEDDPAMYFCQQTKEVPWTFGGGTKLEIKILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 150 - protein, 739 aa, Artificial sequence
  Synthetic polypeptide
MALPVTALLLPLALLLHAARPEQKLISEEDLMADVQLVESGGGLVQAGGSLRLSCAASGRTFSTSAMGWFRQAPGKEREFVARITWSAGYTAYSDSVKGRFTISRDKAKNTVYLQMNSLKPEDTAVYYCASRSAGYSSSLTRREDYAYWGQGTQVTVSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 151 - protein, 740 aa, Artificial sequence
  Synthetic polypeptide
MALPVTALLLPLALLLHAARPEQKLISEEDLMADVQLVESGGGLVQAGGSLRLSCAASGRTISMAAMSWFRQAPGKEREFVAGISRSAGSAVHADSVKGRFTISRDNTKNTLYLQMNSLKAEDTAVYYCAVRTSGFFGSIPRTGTAFDYWGQGTQVTVSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 152 - protein, 740 aa, Artificial sequence
  Synthetic polypeptide
MALPVTALLLPLALLLHAARPEQKLISEEDLMAQVQLVESGGGLVQTGGSLKLSCTASVRTLSYYHVGWFRQAPGKEREFVAGIHRSGESTFYADSVKGRFTISRDNAKNTVHLQMNSLKPEDTAVYYCAQRVRGFFGPLRSTPSWYDYWGQGTQVTVSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 153 - protein, 882 aa, Artificial sequence
  Synthetic polypeptide
MALPVTALLLPLALLLHAARPEQKLISEEDLMAQVQLVESGGRLVQAGDSLRLSCAASGRTFSTSAMAWFRQAPGREREFVAAITWTVGNTILGDSVKGRFTISRDRAKNTVDLQMDNLEPEDTAVYYCSARSRGYVLSVLRSVDSYDYWGQGTQVTVSGGGGSGGGGSGGGGSMAQVQLVESGGGLVQAGGSLRLSCAASGRTFSNYAMGWFRQAPGKEREFVAAISWTGVSTYYADSVKGRFTISRDNDKNTVYVQMNSLIPEDTAIYYCAAVRARSFSDTYSRVNEYDYWGQGTQVTVILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 154 - protein, 815 aa, Artificial sequence
  Synthetic polypeptide
MALPVTALLLPLALLLHAARPMQIPQAPWPVVWAVLQLGWRPGWFLDSPDRPWNPPTFSPALLVVTEGDATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQEQKLISEEDLPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 155 - protein, 817 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCIQKLMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 156 - protein, 809 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCILLEIRAAFLRQRNTALRTEVAELEQEVQRLENEVSQYETRYGPLGGGKGGSGGSGGSMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAA

SEQ ID NO: 157 - protein, 756 aa, Artificial sequence
  Synthetic polypeptide
MALPVTALLLPLALLLHAARPDYKDDDDKGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQLCILPKKKRKVDALDDFDLDMLGSDALDDFDLDMLGSDALDDFDLDMLGSDALDDFDLDMLGSGGSGGSGGSLEIEAAFLERENTALETRVAELRQRVQRLRNRVSQYRTRYGPLGGGK

SEQ ID NO: 158 - protein, 1035 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRIGPVEQKLISEEDL

SEQ ID NO: 159 - protein, 950 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMVPKKKRKVSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGD

SEQ ID NO: 160 - protein, 1173 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMELLSPPLRDIDLTGPDGSLCSFETADDFYDDPCFDSPDLRFFEDLDPRLVHMGALLKPEEHAHFPTAVHPGPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAFYAPGPLPPGRGSEHYSGDSDASSPRSNCSDGMMDYSGPPSGPRRQNGYDTAYYSEAARESRPGKSAAVSSLDCLSSIVERISTDSPAAPALLLADAPPESPPGPPEGASLSDTEQGTQTPSPDAAPQCPAGSNPNAIYQVLGGGSGGGSGGGSMVSKGEELIKENMHMKLYMEGTVNNHHFKCTSEGEGKPYEGTQTMRIKVVEGGPLPFAFDILATSFMYGSRTFINHTQGIPDFFKQSFPEGFTWERVTTYEDGGVLTATQDTSLQDGCLIYNVKIRGVNFPSNGPVMQKKTLGWEANTEMLYPADGGLEGRTDMALKLVGGGHLICNFKTTYRSKKPAKNLKMPGVYYVDHRLERIKEADKETYVEQHEVAVARYCDLPSKLGHKLNGMDELYK

SEQ ID NO: 161 - protein, 1134 aa, Artificial sequence
  Synthetic polypeptide
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRMGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 162 - protein, 701 aa, Artificial sequence
  Synthetic polypeptide
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMIPYKIEAVKSEPVEPPLPSQLHLMYVAAAAFVLLFFVGCGVLLSRKRRRQLCIQKLMSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 163 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 164 - protein, 560 aa, Homo sapiens
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 165 - protein, 272 aa, Homo sapiens
MEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 166 - protein, 517 aa, Homo sapiens
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 167 - protein, 271 aa, Homo sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 168 - protein, 736 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 169 - protein, 482 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 170 - protein, 836 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 171 - protein, 1054 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 172 - protein, 1710 aa, Homo sapiens
MNGHSDEESVRNSSGESSQSDDDSGSASGSGSGSSSGSSSDGSSSQSGSSDSDSGSESGSQSESESDTSRENKVQAKPPKVDGAEFWKSSPSILAVQRSAILKKQQQQQQQQQHQASSNSGSEEDSSSSEDSDDSSSEVKRKKHKDEDWQMSGSGSPSQSGSDSESEEEREKSSCDETESDYEPKNKVKSRKPQNRSKSKNGKKILGQKKRQIDSSEEDDDEEDYDNDKRSSRRQATVNVSYKEDEEMKTDSDDLLEVCGEDVPQPEEEEFETIERFMDCRIGRKGATGATTTIYAVEADGDPNAGFEKNKEPGEIQYLIKWKGWSHIHNTWETEETLKQQNVRGMKKLDNYKKKDQETKRWLKNASPEDVEYYNCQQELTDDLHKQYQIVERIIAHSNQKSAAGYPDYYCKWQGLPYSECSWEDGALISKKFQACIDEYFSRNQSKTTPFKDCKVLKQRPRFVALKKQPSYIGGHEGLELRDYQLNGLNWLAHSWCKGNSCILADEMGLGKTIQTISFLNYLFHEHQLYGPFLLVVPLSTLTSWQREIQTWASQMNAVVYLGDINSRNMIRTHEWTHHQTKRLKFNILLTTYEILLKDKAFLGGLNWAFIGVDEAHRLKNDDSLLYKTLIDFKSNHRLLITGTPLQNSLKELWSLLHFIMPEKFSSWEDFEEEHGKGREYGYASLHKELEPFLLRRVKKDVEKSLPAKVEQILRMEMSALQKQYYKWILTRNYKALSKGSKGSTSGFLNIMMELKKCCNHCYLIKPPDNNEFYNKQEALQHLIRSSGKLILLDKLLIRLRERGNRVLIFSQMVRMLDILAEYLKYRQFPFQRLDGSIKGELRKQALDHFNAEGSEDFCFLLSTRAGGLGINLASADTVVIFDSDWNPQNDLQAQARAHRIGQKKQVNIYRLVTKGSVEEDILERAKKKMVLDHLVIQRMDTTGKTVLHTGSAPSSSTPFNKEELSAILKFGAEELFKEPEGEEQEPQEMDIDEILKRAETHENEPGPLTVGDELLSQFKVANFSNMDEDDIELEPERNSKNWEEIIPEDQRRRLEEEERQKELEEIYMLPRMRNCAKQISFNGSEGRRSRSRRYSGSDSDSISEGKRPKKRGRPRTIPRENIKGFSDAEIRRFIKSYKKFGGPLERLDAIARDAELVDKSETDLRRLGELVHNGCIKALKDSSSGTERTGGRLGKVKGPTFRISGVQVNAKLVISHEEELIPLHKSIPSDPEERKQYTIPCHTKAAHFDIDWGKEDDSNLLIGIYEYGYGSWEMIKMDPDLSLTHKILPDDPDKKPQAKQLQTRADYLIKLLSRDLAKKEALSGAGSSKRRKARAKKNKAMKSIKVKEEIKSDSSPLPSEKSDEDDDKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 173 - protein, 2240 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGLESPRPNIILGLVICQKIKRPANSGELDKMDEKRTRLQPEEADVPAYPKVATVPQSEKKPSKYPLCSADAAVSTTPPGSPPPPPPLPEPPVLKVLSSLKPAAPSPATAATTAAAASTAASSTASSASKTASPLEHILQTLFGKKKSFDPSAREPPGSTAGLPQEPKTTAEDGVPAPPLLDPIVQQFGQFSKDKALEEEEDDRPYDPEEEYDPERAFDTQLVERGRRHEVERAPEAAAAEREEVAYDPEDETILEEAKVTVDDLPNRMCADVRRNSVERPAEPVAGAATPSLVEQQKMLEELNKQIEEQKRQLEEQEEALRQQRAAVGVSMAHFSVSDALMSPPPKSSLPKAELFQQEQQSADKPASLPPASQASNHRDPRQARRLATETGEGEGEPLSRLSARGAQGALPERDASRGGLVGQAPMPVPEEKEPASSPWASGEKPPAGSEQDGWKAEPGEGTRPATVGDSSARPARRVLLPTPPCGALQPGFPLQHDGERDPFTCPGFASQDKALGSAQYEDPRNLHSAGRSSSPAGETEGDREPQARPGEGTAPLPPPGQKVGGSQPPFQGQREPGPHALGMSGLHGPNFPGPRGPAPPFPEENIASNDGPRGPPPARFGAQKGPIPSLFSGQHGPPPYGDSRGPSPSYLGGPRGVAPSQFEERKDPHGEKREFQDAPYNEVTGAPAQFEGTEQAPFLGSRGGAPFQFGGQRRPLLSQLKGPRGGPPPSQFGGQRGPPPGHFVGPRGPHPSQFETARGPHPNQFEGPRGQAPNFMPGPRGIQPQQFEDQRVHSPPRFTNQRAPAPLQFGGLRGSAPFSEKNEQTPSRFHFQGQAPQVMKPGPRPLLELPSHPPQHRKDRWEEAGPPSALSSSAPGQGPEADGQWASADFREGKGHEYRNQTFEGRQRERFDVGPKEKPLEEPDAQGRASEDRRRERERGRNWSRERDWDRPREWDRHRDKDSSRDWDRNRERSANRDREREADRGKEWDRSRERSRNRERERDRRRDRDRSRSRERDRDKARDRERGRDRKDRSKSKESARDPKPEASRASDAGTASQA

SEQ ID NO: 174 - protein, 176 aa, Homo sapiens
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 175 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 176 - protein, 581 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 177 - protein, 595 aa, Homo sapiens [sequence omitted]

SEQ ID NO: 178 - protein, 584 aa, Homo sapiens
MAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 179 - protein, 323 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 180 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 181 - protein, 454 aa, Homo sapiens
MTKREAEELIEIEIDGTEKAECTEESIVEQTYAPAECVSQAIDINEPIGNLKKLLEPRLQCSLDAHEICLQDIQLDPERSLFDQGVKTDGTVQLSVQVISYQGIEPKLNILEIVKPADTVEVVIDPDAHHAESEAHLVEEAQVITLDGTKHITTISDETSEQVTRWAAALEGYRKEQERLGIPYDPIQWSTDQVLHWVVWVMKEFSMTDIDLTTLNISGRELCSLNQEDFFQRVPRGEILWSHLELLRKYVLASQEQQMNEIVTIDQPVQIIPASVQSATPTTIKVINSSAKAAKVQRAPRISGEDRSSPGNRTGNNGQIQLWQFLLELLTDKDARDCISWVGDEGEFKLNQPELVAQKWGQRKNKPTMNYEKLSRALRYYYDGDMICKVQGKRFVYKFVCDLKTLIGYSAAELNRLVTECEQKKLAKMQLHGIAQPVTAVALATASLQTEKDN

SEQ ID NO: 182 - protein, 295 aa, Homo sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 183 - protein, 112 aa, Homo sapiens
MLIFLGCYRRRLEERAGTMSAETASGPTEDQVEILEYNFNKVDKHPDSTTLCLIAAEAGLSEEETQGSDLISRSKIWHPESSPQREGYPHDSLPCLAFDYFSLLPPQCKEMV

SEQ ID NO: 184 - protein, 155 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 185 - protein, 134 aa, Homo sapiens
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 186 - protein, 325 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 187 - protein, 402 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 188 - protein, 411 aa, Homo sapiens
MSVGCACPGCSSKSFKLYSPKEPPNGNAFPPFHPGTMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 189 - protein, 406 aa, Homo sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 190 - protein, 260 aa, Homo sapiens
MAQAALEPGEKPYACPECGKSFSTSGSLVRHQRTHTGEKPYKCPECGKSFSRNDALTEHQRTHTGEKPYKCPECGKSFSSKKHLAEHQRTHTGEKPYACPECGKSFSTSGELVRHQRTHTGEKPYKCPECGKSFSRSDKLVRHQRTHTGEKPYKCPECGKSFSRSDHLTEHQRTHTGKKTSGQAGQASPKKKRKVGRADALDDFDLDMLGSDALDDFDLDMLGSDALDDFDLDMLGSDALDDFDLDMLINYPYDVPDYAS

SEQ ID NO: 191 - protein, 147 aa, Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVS

SEQ ID NO: 192 - protein, 770 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 193 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 194 - protein, 236 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 195 - protein, 313 aa, Homo sapiens
MYVSYLLDKDVSMYPSSVRHSGGLNLAPQNFVSPPQYPDYGGYHVAAAAAAAANLDSAQSPGPSWPAAYGAPLREDWNGYAPGGAAAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQVKTRTKDKYRVVYTDHQRLELEKEFHYSRYITIRRKAELAATLGLSERQVKIWFQNRRAKERKINKKKLQQQQQQQPPQPPPPPPQPPQPQPGPLRSVPEPLSPVSSLQASVSGSVPGVLGPTGGVLNPTVTQ

SEQ ID NO: 196 - protein, 341 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 197 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 198 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 199 - protein, 380 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 200 - protein, 444 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 201 - protein, 335 aa, Homo sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 202 - protein, 516 aa, Homo sapiens
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 203 - protein, 331 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 204 - protein, 521 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 205 - protein, 356 aa, Homo sapiens
MTKSYSESGLMGEPQPQGPPSWTDECLSSQDEEHEADKKEDDLEAMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 206 - protein, 812 aa, Homo sapiens
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLSSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 207 - protein, 968 aa, Homo sapiens
MAEDDPYLGRPEQMFHLDPSLTHTIFNPEVFQPQMALPTDGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 208 - protein, 264 aa, Homo sapiens
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 209 - protein, 750 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 210 - protein, 426 aa, Homo sapiens
MEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

What is claimed is:

1. An isolated nucleic acid comprising a nucleotide sequence encoding a chimeric Notch polypeptide comprising, from N-terminal to C-terminal and in covalent linkage:
   a) an extracellular domain comprising a single-chain Fv (scFv) or a nanobody that specifically binds to an antigen;
   b) a Notch regulatory region comprising a Lin 12-Notch repeat, a heterodimerization domain comprising an S2 proteolytic cleavage site and a transmembrane domain comprising an S3 proteolytic cleavage site; and
   c) an intracellular domain, heterologous to the Notch regulatory region, comprising a transcriptional activator comprising a DNA binding domain, wherein the transcriptional activator replaces a naturally-occurring intracellular notch domain, and wherein binding of the scFv or the nanobody to the antigen in trans induces cleavage at the S2 and S3 proteolytic cleavage sites, thereby releasing the intracellular domain and wherein the chimeric Notch polypeptide does not bind its naturally-occurring ligand Delta.

2. The isolated nucleic acid of claim 1, wherein release of the intracellular domain causes the transcriptional activator to induce expression of an endogenous gene product in a cell comprising the nucleic acid.

3. The isolated nucleic acid of claim 1, wherein release of the intracellular domain causes the transcriptional activator to induce expression of a heterologous gene product in a cell comprising the nucleic acid.

4. The isolated nucleic acid of claim 1, wherein the nucleic acid further comprises a transcriptional control element, responsive to the transcriptional activator, operably linked to a nucleotide sequence encoding a chimeric antigen receptor (CAR).

5. The isolated nucleic acid of claim 1, wherein the nucleic acid further comprises a transcriptional control element, responsive to the transcriptional activator, operably linked to a nucleotide sequence encoding a therapeutic antibody for the treatment of cancer.

6. The isolated nucleic acid of claim 5, wherein the therapeutic antibody for the treatment of cancer is selected from pembrolizumab and tremelimumab.

7. The isolated nucleic acid of claim 1, wherein the Notch regulatory region has at least 85% amino acid sequence identity to any one of the Notch regulatory regions of SEQ ID NO:131, 132 and 135-137.

8. The isolated nucleic acid of claim 1, wherein the Notch regulatory region further comprises, at its N-terminus, one or more epidermal growth factor (EGF) repeats.

9. The isolated nucleic acid of claim 8, wherein the Notch regulatory region comprises, at its N-terminus, 2 to 11 EGF repeats.

10. The isolated nucleic acid of claim 1, wherein the chimeric Notch polypeptide comprises a synthetic linker.

11. The isolated nucleic acid of claim 8, wherein the chimeric Notch polypeptide comprises a synthetic linker between the one or more EGF repeats.

12. The isolated nucleic acid of claim 1, wherein the antigen is a cancer-associated antigen.

13. The isolated nucleic acid of claim 1, wherein the S2 proteolytic cleavage site is an ADAM-17-type protease cleavage site comprising an Ala-Val dipeptide sequence.

14. The isolated nucleic acid of claim 1, wherein the S3 proteolytic cleavage site is a gamma-secretase (γ-secretase) cleavage site comprising a Gly-Val dipeptide sequence.

15. The isolated nucleic acid of claim 1, wherein the chimeric Notch polypeptide further comprises an S1 proteolytic cleavage site.

16. The isolated nucleic acid of claim 15, wherein the S1 proteolytic cleavage site is a furin-like protease cleavage site comprising the amino acid sequence Arg-X-(Arg/Lys)-Arg, where X is any amino acid.

17. The isolated nucleic acid of claim 1, wherein the chimeric Notch polypeptide lacks an S1 proteolytic cleavage site.

18. A recombinant expression vector comprising the nucleic acid of claim 1.

19. The recombinant expression vector of claim 18, wherein the recombinant expression vector further comprises a transcriptional control element, responsive to the transcriptional activator, operably linked to a nucleotide sequence encoding a chimeric antigen receptor (CAR).

20. The recombinant expression vector of claim 18, wherein the recombinant expression vector further comprises a transcriptional control element, responsive to the transcriptional activator, operably linked to a nucleotide sequence encoding a therapeutic antibody for the treatment of cancer.

21. A cell genetically modified cell comprising the nucleic acid of claim 1.

22. The cell of claim 21, wherein the cell is selected from the group consisting of: an immune cell, a neuron, an epithelial cell, an endothelial cell, or a stem cell.

23. The cell of claim 22, wherein the immune cell is selected from the group consisting of: a T cell, a B cell, a monocyte, a natural killer cell, a dendritic cell, a macrophage, a regulatory T cell, a helper T cell, or a cytotoxic T cell.

24. The cell of claim 23, wherein the immune cell is a T cell.

\* \* \* \* \*

UNITED STATES PATENT AND TRADEMARK OFFICE
CERTIFICATE OF CORRECTION

PATENT NO. : 9,670,281 B2  
APPLICATION NO. : 15/096971  
DATED : June 6, 2017  
INVENTOR(S) : Wendell A. Lim et al.

Page 1 of 1

It is certified that error appears in the above-identified patent and that said Letters Patent is hereby corrected as shown below:

On the Title Page

Please replace (72) inventors:
"Wendell A. Lim, San Francisco, CA (US); Leonardo Morsut, San Francisco, CA (US); Kole T. Royal, San Francisco, CA (US)"

With:
-- Wendell A. Lim, San Francisco, CA (US); Leonardo Morsut, San Francisco, CA (US); Kole T. Royal, San Francisco, CA (US); Justin Thomas Farlow, San Francisco, CA (US) --

Signed and Sealed this
Ninth Day of January, 2018

Joseph Matal
*Performing the Functions and Duties of the*
*Under Secretary of Commerce for Intellectual Property and*
*Director of the United States Patent and Trademark Office*